US012774281B2

(12) United States Patent
Reynolds et al.

(10) Patent No.: US 12,774,281 B2
(45) Date of Patent: Oct. 27, 2026

(54) HETEROCYCLIC AMIDES AND THEIR USE FOR MODULATING SPLICING

(71) Applicant: REMIX THERAPEUTICS INC., Cambridge, MA (US)

(72) Inventors: Dominic Reynolds, Stoneham, MA (US); Michael W. Seiler, Belmont, MA (US); Anant A. Agrawal, Waltham, MA (US); Frederic Vaillancourt, Newton, MA (US); Peter Smith, Arlington, MA (US)

(73) Assignee: REMIX THERAPEUTICS INC., Watertown, MA (US)

( * ) Notice: Subject to any disclaimer, the term of this patent is extended or adjusted under 35 U.S.C. 154(b) by 928 days.

(21) Appl. No.: 17/802,719

(22) PCT Filed: Feb. 28, 2021

(86) PCT No.: PCT/US2021/020154
§ 371 (c)(1),
(2) Date: Aug. 26, 2022

(87) PCT Pub. No.: WO2021/174165
PCT Pub. Date: Sep. 2, 2021

(65) Prior Publication Data
US 2023/0365566 A1 Nov. 16, 2023

Related U.S. Application Data

(60) Provisional application No. 63/126,492, filed on Dec. 16, 2020, provisional application No. 63/072,790, filed on Aug. 31, 2020, provisional application No. 63/040,484, filed on Jun. 17, 2020, provisional application No. 63/007,333, filed on Apr. 8, 2020,
(Continued)

(51) Int. Cl.

| | |
|---|---|
| *C07D 487/04* | (2006.01) |
| *A61K 31/496* | (2006.01) |
| *A61K 31/498* | (2006.01) |
| *A61K 31/502* | (2006.01) |
| *A61K 31/5025* | (2006.01) |
| *A61K 31/53* | (2006.01) |
| *A61K 31/55* | (2006.01) |
| *A61P 5/00* | (2006.01) |
| *A61P 9/00* | (2006.01) |
| *A61P 11/00* | (2006.01) |
| *A61P 25/00* | (2006.01) |
| *A61P 25/28* | (2006.01) |
| *A61P 31/00* | (2006.01) |
| *A61P 35/00* | (2006.01) |
| *A61P 37/00* | (2006.01) |
| *C07D 401/14* | (2006.01) |
| *C07D 403/04* | (2006.01) |
| *C07D 403/12* | (2006.01) |
| *C07D 405/12* | (2006.01) |
| *C07D 413/12* | (2006.01) |
| *C07D 417/12* | (2006.01) |
| *C07D 471/04* | (2006.01) |
| *C07D 471/08* | (2006.01) |
| *C07D 487/10* | (2006.01) |
| *C07D 519/00* | (2006.01) |

(52) U.S. Cl.
CPC .......... *C07D 487/04* (2013.01); *A61K 31/496* (2013.01); *A61K 31/498* (2013.01); *A61K 31/502* (2013.01); *A61K 31/5025* (2013.01); *A61K 31/53* (2013.01); *A61K 31/55* (2013.01); *C07D 401/14* (2013.01); *C07D 403/04* (2013.01); *C07D 403/12* (2013.01); *C07D 405/12* (2013.01); *C07D 413/12* (2013.01); *C07D 417/12* (2013.01); *C07D 471/04* (2013.01); *C07D 519/00* (2013.01)

(58) Field of Classification Search
None
See application file for complete search history.

(56) References Cited

U.S. PATENT DOCUMENTS 8,772,505 B2 7/2014 Chen et al.
2007/0073054 A1 3/2007 Kimura et al.
(Continued)

FOREIGN PATENT DOCUMENTS

CA 3105174 A1 1/2020
CN 102020643 A 4/2011
(Continued)

OTHER PUBLICATIONS

STN, ACS CAS 627894-60-4 Registry, Dec. 19, 2003 (Year: 2003).*
(Continued)

*Primary Examiner* — Kortney L. Klinkel
*Assistant Examiner* — Alison Azar Hastings
(74) *Attorney, Agent, or Firm* — Lando & Anastasi, LLP

(57) ABSTRACT

The present disclosure features compounds of formula (I-a) and related compositions that, inter alia, modulate nucleic acid splicing e.g., splicing of a pre-mRNA, as well as methods of use thereof.

(I-a)

22 Claims, No Drawings

Specification includes a Sequence Listing.

Related U.S. Application Data provisional application No. 62/983,541, filed on Feb. 28, 2020.

(56) References Cited

U.S. PATENT DOCUMENTS

| | | | |
|---|---|---|---|
| 2007/0254894 A1 | 11/2007 | Kane et al. | |
| 2010/0105667 A1 | 4/2010 | Furet et al. | |
| 2011/0288089 A1 | 11/2011 | Renold et al. | |
| 2013/0164258 A1 | 6/2013 | Chen et al. | |
| 2014/0256706 A1 | 9/2014 | Wang et al. | |
| 2018/0118748 A1 | 5/2018 | Slaugenhaupt et al. | |
| 2019/0119236 A1 | 4/2019 | Pandey et al. | |
| 2019/0233440 A1 | 8/2019 | Planken et al. | |

FOREIGN PATENT DOCUMENTS

| | | | | |
|---|---|---|---|---|
| CN | 102036963 A | 4/2011 | | |
| CN | 102958930 A | 3/2013 | | |
| CN | 105377851 A | 3/2016 | | |
| CN | 104341403 B | 6/2016 | | |
| CN | 106220644 A | 12/2016 | | |
| CN | 109180690 A | 1/2019 | | |
| EP | 2481739 A1 | 8/2012 | | |
| EP | 3287463 A1 * | 2/2018 | | A61K 31/517 |
| EP | 3476848 A1 | 5/2019 | | |
| JP | 2012-028440 A | 2/2012 | | |
| KR | 2014-0125061 A | 10/2014 | | |
| WO | 2008/003958 A2 | 1/2008 | | |
| WO | 2008/019124 A1 | 2/2008 | | |
| WO | 2008/040951 A1 | 4/2008 | | |
| WO | 2009/108838 A1 | 9/2009 | | |
| WO | 2009/133136 A1 | 11/2009 | | |
| WO | 2009/141386 A1 | 11/2009 | | |
| WO | 2011/148922 A1 | 12/2011 | | |
| WO | 2012/000595 A1 | 1/2012 | | |
| WO | 2013/169622 A1 | 11/2013 | | |
| WO | 2014/085210 A1 | 6/2014 | | |
| WO | 2014/209841 A2 | 12/2014 | | |
| WO | 2016/004254 A1 | 1/2016 | | |
| WO | 2016/049524 A1 | 3/2016 | | |
| WO | 2016/061043 A1 | 4/2016 | | |
| WO | 2016/169504 A1 | 10/2016 | | |
| WO | 2016/196386 A1 | 12/2016 | | |
| WO | 2017/147328 A1 | 8/2017 | | |
| WO | 2018/140512 A1 | 8/2018 | | |
| WO | 2018/226622 A1 | 12/2018 | | |
| WO | 2019/028440 A1 | 2/2019 | | |
| WO | 2019/079649 A1 | 4/2019 | | |
| WO | 2019/232244 A2 | 12/2019 | | |
| WO | 2020/005873 A1 | 1/2020 | | |
| WO | WO-2020018610 A1 * | 1/2020 | | C07D 413/04 |
| WO | 2020/123395 A1 | 6/2020 | | |
| WO | 2020/132459 A1 | 6/2020 | | |
| WO | 2020/216190 A1 | 10/2020 | | |
| WO | 2021/007378 A1 | 1/2021 | | |

OTHER PUBLICATIONS

WO2020004521A1_ English (Year: 2020).*

Pais et al., "Preparation and pH-switching of fluorescent borylated arylisoquinolines for multilevel molecular logic" The Journal of Organic Chemistry, 2013, vol. 78, No. 16, pp. 7949-7961.

Lu et al., "Arylazolyl(azinyl)thioacetanilides. Part 20: Discovery of novel purinylthioacetanilides derivatives as potent HIV-1 NNRTIs via a structure-based bioisosterism approach" Bioorganic & Medicinal Chemistry, 2016, vol. 24, No. 18, pp. 4424-4433.

Havens et al., "Targeting RNA splicing for disease therapy" Wiley Interdisciplinary Reviews: RNA, 2013, vol. 4, No. 3, pp. 247-266.

International search report and written opinion for application No. PCT/US2021/020153 mailed Jul. 28, 2021.

Pawellek et al., "Identification of small molecule inhibitors of pre-mRNA splicing" Journal of Biological Chemistry, 2014, vol. 289, No. 50, pp. 34683-34698.

International search report and written opinion for application No. PCT/US2021/020154 mailed Jul. 7, 2021.

Reed et al., "Discovery of VU6027459: A first-in-class selective and CNS penetrant mGlu7 positive allosteric modulator tool compound" ACS Medicinal Chemistry Letters, 2020, vol. 11, No. 9, pp. 1773-1779.

Smits et al., "Ligand based design of novel histamine H4 receptor antagonists; fragment optimization and analysis of binding kinetics" Bioorganic & Medicinal Chemistry Letters, 2011, vol. 22, No. 1, pp. 461-467.

Schoffmann et al., "Efficient modulation of g-Aminobutyric acid type A receptors by piperine derivatives" Journal of Medicinal Chemistry, 2014, vol. 57, No. 13, pp. 5602-5619.

International search report and written opinion for application No. PCT/US2021/020152 mailed Jun. 25, 2021.

Srivastava et al., "Syntheses and antifilarial profile of 5-Amino and 5,8-Diamino-Isoquinoline derivatives: A new class of antifilarial agents" Bioorganic & Medicinal Chemistry Letters, 1996, vol. 6, No. 22, pp. 2623-2628.

Pais et al., "Preparation and pH-switching of fluorescent borylated arylisoquinolines for multilevel molecular logic" Journal of Organic Chemistry, 2013, vol. 78, No. 16, pp. 7949-7961.

Lu et al., "Arylazolyl(azinyl)thioacetanilides, Part 20: Discovery of novel purinylthioacetanilides derivatives as potent HIV-1 NNRTIs via a structure-based bioisoterism approach" Bioorganic & Medicinal Chemistry, 2016, vol. 24, No. 18, pp. 4424-4433.

Database accession No. 2307382-78-9, "quinoline derivatives", Database Registry [Online] Chemical Abstract Service, Columbus, Ohio, US; May 12, 2019.

Pawellek et al., "Identification of small molecule inhibitors of Pre-mRNA splicing" The Journal of Biological Chemistry, 2014, vol. 289, No. 50, pp. 34683-34698.

Campagne et al., "Structual basis of a small molecule targeting RNA for a specific correction" Nature Chemical Biology, Dec. 2019, vol. 15, No. 12, pp. 1191-1198.

Suzuki et al., "Preparation, properties, and X-ray structures of 5,5'-bi(8-aminoquinoxalyl)s: novel Wurster-type electron donors with a heterobiaryl skeleton" Tetrahedron Letters. vol. 45. 2004. pp 329-333.

Barsu et al., "Site-selective C—H bond carbonylation with CO2 and cobalt-catalysis", Catalysis Science & Technology, 2018. pp 5963-5969.

CAS Registry No. 1625630-02-05, entered on Sep. 24, 2014.

CAS Registry No. 1003225-26-0, entered on Feb. 13, 2008.

STN, ACS CAS 627894-60-4 Registry, Dec. 19, 2003.

Pinard et al., "Discovery of a Novel Class of Survival Motor Neuron 2 Splicing Modifiers for the Treatment of Spinal Muscular Atrophy", Journal of Medicinal Chemistry, 2017, vol. 60, pp. 4444-4457.

* cited by examiner

HETEROCYCLIC AMIDES AND THEIR USE FOR MODULATING SPLICING

CLAIM OF PRIORITY

This application is a U.S. National Phase Application under 35 U.S.C. § 371 of International Application No. PCT/US2021/020154, filed Feb. 28, 2021, which claims priority to U.S. Application No. 62/983,541, filed Feb. 28, 2020; U.S. Application No. 63/007,333, filed Apr. 8, 2020; U.S. Application No. 63/040,484, filed Jun. 17, 2020; U.S. Application No. 63/072,790, filed Aug. 31, 2020; and U.S. Application No. 63/126,492, filed Dec. 16, 2020. The disclosure of each of the foregoing applications is incorporated herein by reference in its entirety.

SEQUENCE LISTING

The instant application contains a Sequence Listing which has been submitted electronically in ASCII format and is hereby incorporated by reference in its entirety. Said ASCII copy, created on Jun. 17, 2021, is named R2103-7014WO-_SL.txt and is 1,386,978 bytes in size.

BACKGROUND

Alternative splicing is a major source of protein diversity in higher eukaryotes and is frequently regulated in a tissue-specific or development stage-specific manner. Disease associated alternative splicing patterns in pre-mRNAs are often mapped to changes in splice site signals or sequence motifs and regulatory splicing factors (Faustino and Cooper (2003), *Genes Dev* 17(4):419-37). Current therapies to modulate RNA expression involve oligonucleotide targeting and gene therapy; however, each of these modalities exhibit unique challenges as currently presented. As such, there is a need for new technologies to modulate RNA expression, including the development of small molecule compounds that target splicing.

SUMMARY

The present disclosure features compounds and related compositions that, inter alia, modulate nucleic acid splicing, e.g., splicing of a pre-mRNA, as well as methods of use thereof. In an embodiment, the compounds described herein are compounds of Formula (I) (e.g., a compound of Formulas (I-a), (I-b), (I-c), (I-d), (I-e), (I-f), or (I-g)) and pharmaceutically acceptable salts, solvates, hydrates, tautomers, or stereoisomers thereof. The present disclosure additionally provides methods of using the compounds of the invention (e.g., compounds of Formulas (I), (I-a), (I-b), (I-c), (I-d), (I-e), (I-f), (I-g), or (I-h), and pharmaceutically acceptable salts, solvates, hydrates, tautomers, stereoisomers thereof), and compositions thereof, e.g., to target, and in embodiments bind or form a complex with, a nucleic acid (e.g., a pre-mRNA or nucleic acid component of a small nuclear ribonucleoprotein (snRNP) or spliceosome), a protein (e.g., a protein component of an snRNP or spliceosome, e.g., a member of the splicing machinery, e.g., one or more of the U1, U2, U4, U5, U6, U11, U12, U4atac, U6atac snRNPs), or a combination thereof. In another aspect, the compounds described herein may be used to alter the composition or structure of a nucleic acid (e.g., a pre-mRNA or mRNA (e.g., a pre-mRNA and the mRNA which arises from the pre-mRNA), e.g., by increasing or decreasing splicing at a splice site. In some embodiments, increasing or decreasing splicing results in modulating the level of a gene product (e.g., an RNA or protein) produced.

In another aspect, the compounds described herein may be used for the prevention and/or treatment of a disease, disorder, or condition, e.g., a disease, disorder or condition associated with splicing, e.g., alternative splicing. In some embodiments, the compounds described herein (e.g., compounds of Formulas (I), (I-a), (I-b), (I-c), (I-d), (I-e), (I-f), (I-g), or (I-h), and pharmaceutically acceptable salts, solvates, hydrates, tautomers, stereoisomers thereof) and compositions thereof are used for the prevention and/or treatment of a proliferative disease, disorder, or condition (e.g., a disease, disorder, or condition characterized by unwanted cell proliferation, e.g., a cancer or a benign neoplasm) in a subject. In some embodiments, the compounds described herein (e.g., compounds of Formulas (I), (I-a), (I-b), (I-c), (I-d), (I-e), (I-f), (I-g), or (I-h), and pharmaceutically acceptable salts, solvates, hydrates, tautomers, stereoisomers thereof) and compositions thereof are used for the prevention and/or treatment of a non-proliferative disease, disorder, or condition. In some embodiments, the compounds described herein (e.g., compounds of Formulas (I), (I-a), (I-b), (I-c), (I-d), (I-e), (I-f), (I-g), or (I-h), and pharmaceutically acceptable salts, solvates, hydrates, tautomers, stereoisomers thereof) and compositions thereof are used for the prevention and/or treatment of a neurological disease or disorder, an autoimmune disease or disorder, immunodeficiency disease or disorder, a lysosomal storage disease or disorder, a cardiovascular disease or disorder, a metabolic disease or disorder, a respiratory disease or disorder, a renal disease or disorder, or an infectious disease in a subject.

In another aspect, the present disclosure features a compound of Formula (I-a):

(I-a)

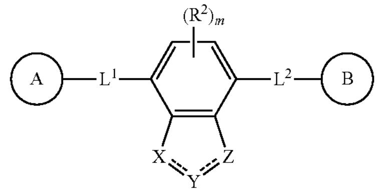

or a pharmaceutically acceptable salt, solvate, hydrate, tautomer, or stereoisomer thereof, wherein A and B are each independently cycloalkyl, heterocyclyl, aryl, or heteroaryl, each of which is optionally substituted with one or more $R^1$; X, Y, and Z are each independently $C(R^{3a})$, $C(R^{3a})(R^{3b})$, N, $N(R^{3c})$, or O, wherein at least one of X, Y, and Z is N, $N(R^{3c})$, or O, and the bonds in the ring comprising X, Y, and Z may be single or double bonds as valency permits; each of $L^1$ and $L^2$ is independently absent, $C_1$-$C_6$-alkylene, $C_1$-$C_6$-heteroalkylene, —O—, —C(O)—, —$N(R^4)$—, —$N(R^4)$C(O)—, or —C(O)$N(R^4)$—, wherein each alkylene and heteroalkylene is optionally substituted with one or more $R^5$; each $R^1$ is independently hydrogen, $C_1$-$C_6$-alkyl, $C_2$-$C_6$-alkenyl, $C_2$-$C_6$-alkynyl, $C_1$-$C_6$-heteroalkyl, $C_1$-$C_6$-haloalkyl, cycloalkyl, heterocyclyl, aryl, $C_1$-$C_6$ alkylene-aryl, $C_1$-$C_6$ alkenylene-aryl, $C_1$-$C_6$ alkylene-heteroaryl, heteroaryl, halo, cyano, oxo, —$OR^A$, —$NR^BR^C$, —$NR^B$C(O)$R^D$, —$NO_2$, —C(O)$NR^BR^C$, —C(O)$R^D$, —C(O)$OR^D$, —$SR^E$, or —$S(O)_xR^D$, wherein each alkyl, alkylene, alkenyl, alkynyl, heteroalkyl, haloalkyl, cycloalkyl, heterocyclyl, aryl, and heteroaryl is optionally substituted with one or more $R^6$; or two $R^1$ groups, together with the atoms to which they are attached, form a 3-7-membered cycloalkyl, heterocyclyl, aryl, or heteroaryl, wherein each cycloalkyl, heterocyclyl, aryl, and heteroaryl is optionally substituted with one or more $R^6$; each $R^2$ is independently hydrogen, $C_1$-$C_6$-alkyl, $C_2$-$C_6$-alkenyl, $C_2$-$C_6$-alkynyl, $C_1$-$C_6$-heteroalkyl, $C_1$-$C_6$-haloalkyl, halo, cyano, or —$OR^A$; $R^{3a}$ and $R^{3b}$ are each independently hydrogen, $C_1$-$C_6$-alkyl, $C_1$-$C_6$-heteroalkyl, $C_1$-$C_6$-haloalkyl, halo, cyano, —$OR^A$, —$NR^BR^C$, —$C(O)R^D$, or —$C(O)OR^D$; or each of $R^{3a}$ and $R^{3b}$, together with the carbon atom to which they are attached, form an oxo group; $R^{3c}$ is hydrogen or $C_1$-$C_6$-alkyl; each $R^4$ is independently hydrogen, $C_1$-$C_6$-alkyl, or $C_1$-$C_6$-haloalkyl; each $R^5$ is independently hydrogen, $C_1$-$C_6$-alkyl, $C_1$-$C_6$-heteroalkyl, $C_1$-$C_6$-haloalkyl, cycloalkyl, halo, cyano, oxo, —$OR^A$, —$NR^BR^C$, —$C(O)R^D$, or —$C(O)OR^D$; each $R^6$ is independently $C_1$-$C_6$-alkyl, $C_2$-$C_6$-alkenyl, $C_2$-$C_6$-alkynyl, $C_1$-$C_6$-heteroalkyl, $C_1$-$C_6$-haloalkyl, cycloalkyl, heterocyclyl, aryl, heteroaryl, halo, cyano, oxo, —$OR^A$, —$NR^BR^C$, —$NR^BC(O)R^D$, —$NO_2$, —$C(O)NR^BR^C$, —$C(O)R^D$, —$C(O)OR^D$, —$SR^E$, or —$S(O)_xR^D$, wherein each alkyl, alkenyl, alkynyl, heteroalkyl, haloalkyl, cycloalkyl, heterocyclyl, aryl, and heteroaryl is optionally substituted with one or more $R^{11}$; each $R^7$ is $C_1$-$C_6$-alkyl, halo, cyano, oxo, or —$OR^{A1}$; each $R^{11}$ is independently $C_1$-$C_6$-alkyl, $C_1$-$C_6$-heteroalkyl, $C_1$-$C_6$-haloalkyl, cycloalkyl, heterocyclyl, aryl, heteroaryl, halo, cyano, oxo, or —$OR^A$; each $R^A$ is independently hydrogen, $C_1$-$C_6$ alkyl, $C_1$-$C_6$ haloalkyl, aryl, heteroaryl, $C_1$-$C_6$ alkylene-aryl, $C_1$-$C_6$ alkylene-heteroaryl, —$C(O)R^D$, or —$S(O)_xR^D$; each of $R^B$ and $R^C$ is independently hydrogen, $C_1$-$C_6$ alkyl, $C_1$-$C_6$ heteroalkyl, cycloalkyl, heterocyclyl, or —$OR^A$; or $R^B$ and $R^C$ together with the atom to which they are attached form a 3-7-membered heterocyclyl ring optionally substituted with one or more $R^7$; each $R^D$ and $R^E$ is independently hydrogen, $C_1$-$C_6$ alkyl, $C_2$-$C_6$ alkenyl, $C_2$-$C_6$ alkynyl, $C_1$-$C_6$ heteroalkyl, $C_1$-$C_6$ haloalkyl, cycloalkyl, heterocyclyl, aryl, heteroaryl, $C_1$-$C_6$ alkylene-aryl, or $C_1$-$C_6$ alkylene-heteroaryl; each $R^{A1}$ is hydrogen or $C_1$-$C_6$-alkyl; m is 0, 1, or 2; and x is 0, 1, or 2.

In another aspect, the present invention provides pharmaceutical compositions comprising a compound of Formula (I) (e.g., a compound of Formulas (I-a), (I-b), (I-c), (I-d), (I-e), (I-f), (I-g), (I-h), or (I-i)), or a pharmaceutically acceptable salt, solvate, hydrate, tautomer, or stereoisomer thereof, and optionally a pharmaceutically acceptable excipient. In an embodiment, the pharmaceutical compositions described herein include an effective amount (e.g., a therapeutically effective amount) of a compound of Formula (I) (e.g., a compound of Formulas (I), (I-a), (I-b), (I-c), (I-d), (I-e), (I-f), (I-g), or (I-h)), or a pharmaceutically acceptable salt, solvate, hydrate, tautomer, or stereoisomer thereof.

In another aspect, the present disclosure provides methods for modulating splicing, e.g., splicing of a nucleic acid (e.g., a DNA or RNA, e.g., a pre-mRNA) with a compound of Formula (I) (e.g., a compound of Formulas (I), (I-a), (I-b), (I-c), (I-d), (I-e), (I-f), (I-g), or (I-h)) or a pharmaceutically acceptable salt, solvate, hydrate, tautomer, or stereoisomer thereof. In another aspect, the present disclosure provides compositions for use in modulating splicing, e.g., splicing of a nucleic acid (e.g., a DNA or RNA, e.g., a pre-mRNA) with a compound of Formula (I) (e.g., a compound of Formulas (I), (I-a), (I-b), (I-c), (I-d), (I-e), (I-f), (I-g), or (I-h)) or a pharmaceutically acceptable salt, solvate, hydrate, tautomer, or stereoisomer thereof. Modulation of splicing may comprise impacting any step involved in splicing and may include an event upstream or downstream of a splicing event. For example, in some embodiments, the compound of Formula (I) binds to a target, e.g., a target nucleic acid (e.g., DNA or RNA, e.g., a precursor RNA, e.g., a pre-mRNA), a target protein, or combination thereof (e.g., an snRNP and a pre-mRNA). A target may include a splice site in a pre-mRNA or a component of the splicing machinery, such as the U1 snRNP. In some embodiments, the compound of Formula (I) alters a target nucleic acid (e.g., DNA or RNA, e.g., a precursor RNA, e.g., a pre-mRNA), target protein, or combination thereof. In some embodiments, the compound of Formula (I) increases or decreases splicing at a splice site on a target nucleic acid (e.g., an RNA, e.g., a precursor RNA, e.g., a pre-mRNA) by about 0.5% or more (e.g., about 1%, 2%, 3%, 4%, 5%, 10%, 20%, 30%, 40%, 50%, 75%, 90%, 95%, or more), relative to a reference (e.g., the absence of a compound of Formula (I), e.g., in a healthy or diseased cell or tissue). In some embodiments, the presence of a compound of Formula (I) results an increase or decrease of transcription of a target nucleic acid (e.g., an RNA) by about 0.5% or more (e.g., about 1%, 2%, 3%, 4%, 5%, 10%, 20%, 30%, 40%, 50%, 75%, 90%, 95%, or more), relative to a reference (e.g., the absence of a compound of Formula (I), e.g., in a healthy or diseased cell or tissue).

In another aspect, the present disclosure provides methods for preventing and/or treating a disease, disorder, or condition in a subject by administering a compound of Formula (I) (e.g., a compound of Formulas (I), (I-a), (I-b), (I-c), (I-d), (I-e), (1-f), (I-g), or (I-h)) or a pharmaceutically acceptable salt, solvate, hydrate, tautomer, or stereoisomer thereof, or related compositions. In some embodiments, the disease or disorder entails unwanted or aberrant splicing. In some embodiments, the disease or disorder is a proliferative disease, disorder, or condition. Exemplary proliferative diseases include cancer, a benign neoplasm, or angiogenesis. In other embodiments, the present disclosure provides methods for treating and/or preventing a non-proliferative disease, disorder, or condition. In still other embodiments, the present disclosure provides methods for treating and/or preventing a neurological disease or disorder, autoimmune disease or disorder, immunodeficiency disease or disorder, lysosomal storage disease or disorder, cardiovascular disease or disorder, metabolic disease or disorder, respiratory disease or disorder, renal disease or disorder, or infectious disease.

In another aspect, the present disclosure provides methods of down-regulating the expression of (e.g., the level of or the rate of production of) a target protein with a compound of Formula (I) (e.g., a compound of Formulas (I), (I-a), (I-b), (I-c), (I-d), (I-e), (I-f), (I-g), or (I-h)) or a pharmaceutically acceptable salt, solvate, hydrate, tautomer, or stereoisomer thereof in a biological sample or subject. In another aspect, the present disclosure provides methods of up-regulating the expression of (e.g., the level of or the rate of production of) a target protein with a compound of Formula (I) (e.g., a compound of Formulas (I), (I-a), (I-b), (I-c), (I-d), (I-e), (I-f), (I-g), or (I-h)) or a pharmaceutically acceptable salt, solvate, hydrate, tautomer, or stereoisomer thereof in a biological sample or subject. In another aspect, the present disclosure provides methods of altering the isoform of a target protein with a compound of Formula (I) (e.g., a compound of Formulas (I), (I-a), (I-b), (I-c), (I-d), (I-e), (I-f), (I-g), or (I-h))) or a pharmaceutically acceptable salt, solvate, hydrate, tautomer, or stereoisomer thereof in a biological sample or subject. Another aspect of the disclosure relates to methods of inhibiting the activity of a target protein in a biological sample or subject. In some embodiments, administration of a compound of Formula (I) to a biological sample, a cell, or a subject comprises inhibition of cell growth or induction of cell death.

In another aspect, the present disclosure provides compositions for use in preventing and/or treating a disease, disorder, or condition in a subject by administering a compound of Formula (I) (e.g., a compound of Formulas (I), (I-a), (I-b), (I-c), (I-d), (I-e), (I-f), (I-g), or (I-h)) or a pharmaceutically acceptable salt, solvate, hydrate, tautomer, or stereoisomer thereof, or related compositions. In some embodiments, the disease or disorder entails unwanted or aberrant splicing. In some embodiments, the disease or disorder is a proliferative disease, disorder, or condition. Exemplary proliferative diseases include cancer, a benign neoplasm, or angiogenesis. In other embodiments, the present disclosure provides methods for treating and/or preventing a non-proliferative disease, disorder, or condition. In still other embodiments, the present disclosure provides methods for treating and/or preventing a neurological disease or disorder, autoimmune disease or disorder, immunodeficiency disease or disorder, lysosomal storage disease or disorder, cardiovascular disease or disorder, metabolic disease or disorder, respiratory disease or disorder, renal disease or disorder, or infectious disease.

In another aspect, the present disclosure provides compositions for use in down-regulating the expression of (e.g., the level of or the rate of production of) a target protein with a compound of Formula (I) (e.g., a compound of Formulas (I), (I-a), (I-b), (I-c), (I-d), (I-e), (I-f), (I-g), or (I-h)) or a pharmaceutically acceptable salt, solvate, hydrate, tautomer, or stereoisomer thereof in a biological sample or subject. In another aspect, the present disclosure provides compositions for use in up-regulating the expression of (e.g., the level of or the rate of production of) a target protein with a compound of Formula (I) (e.g., a compound of Formulas (I), (I-a), (I-b), (I-c), (I-d), (I-e), (I-f), (I-g), or (I-h)) or a pharmaceutically acceptable salt, solvate, hydrate, tautomer, or stereoisomer thereof in a biological sample or subject. In another aspect, the present disclosure provides compositions for use in altering the isoform of a target protein with a compound of Formula (I) (e.g., a compound of Formulas (I), (I-a), (I-b), (I-c), (I-d), (I-e), (I-f), (I-g), or (I-h))) or a pharmaceutically acceptable salt, solvate, hydrate, tautomer, or stereoisomer thereof in a biological sample or subject. Another aspect of the disclosure relates to compositions for use in inhibiting the activity of a target protein in a biological sample or subject. In some embodiments, administration of a compound of Formula (I) to a biological sample, a cell, or a subject comprises inhibition of cell growth or induction of cell death.

In another aspect, the present disclosure features kits comprising a container with a compound of Formula (I) (e.g., a compound of Formulas (I), (I-a), (I-b), (I-c), (I-d), (I-e), (I-f), (I-g), or (I-h)), or a pharmaceutically acceptable salt, solvate, hydrate, tautomer, stereoisomer thereof, or a pharmaceutical composition thereof. In certain embodiments, the kits described herein further include instructions for administering the compound of Formula (I) or the pharmaceutically acceptable salt, solvate, hydrate, tautomer, stereoisomer thereof, or the pharmaceutical composition thereof.

In any and all aspects of the present disclosure, in some embodiments, the compound, target nucleic acid (e.g., DNA, RNA, e.g., pre-mRNA), or target protein described herein is a compound, target nucleic acid (e.g., DNA, RNA, e.g., pre-mRNA), or target protein other than a compound, target nucleic acid (e.g., DNA, RNA, e.g., pre-mRNA), or target protein described one of U.S. Pat. No. 8,729,263, U.S. Publication No. 2015/0005289, WO 2014/028459, WO 2016/128343, WO 2016/196386, WO 2017/100726, WO 2018/232039, WO 2018/098446, WO 2019/028440, WO 2019/060917, and WO 2019/199972. In some embodiments, the compound, target nucleic acid (e.g., DNA, RNA, e.g., pre-mRNA), or target protein described herein is a compound, target nucleic acid (e.g., DNA, RNA, e.g., pre-mRNA), or target protein described one of U.S. Pat. No. 8,729,263, U.S. Publication No. 2015/0005289, WO 2014/028459, WO 2016/128343, WO 2016/196386, WO 2017/100726, WO 2018/232039, WO 2018/098446, WO 2019/028440, WO 2019/060917, and WO 2019/199972, each of which is incorporated herein by reference in its entirety.

The details of one or more embodiments of the invention are set forth herein. Other features, objects, and advantages of the invention will be apparent from the Detailed Description, the Examples, and the Claims.

DETAILED DESCRIPTION

Selected Chemical Definitions

Definitions of specific functional groups and chemical terms are described in more detail below. The chemical elements are identified in accordance with the Periodic Table of the Elements, CAS version, *Handbook of Chemistry and Physics,* 75$^{th}$ Ed., inside cover, and specific functional groups are generally defined as described therein. Additionally, general principles of organic chemistry, as well as specific functional moieties and reactivity, are described in Thomas Sorrell, Organic Chemistry, University Science Books, Sausalito, 1999; Smith and March, *March's Advanced Organic Chemistry,* 5$^{th}$ Edition, John Wiley & Sons, Inc., New York, 2001; Larock, Comprehensive Organic Transformations, VCH Publishers, Inc., New York, 1989; and Carruthers, *Some Modern Methods of Organic Synthesis,* 3$^{rd}$ Edition, Cambridge University Press, Cambridge, 1987.

The abbreviations used herein have their conventional meaning within the chemical and biological arts. The chemical structures and formulae set forth herein are constructed according to the standard rules of chemical valency known in the chemical arts.

When a range of values is listed, it is intended to encompass each value and sub-range within the range. For example "$C_1$-$C_6$ alkyl" is intended to encompass, $C_1$, $C_2$, $C_3$, $C_4$, $C_5$, $C_6$, $C_1$-$C_6$, $C_1$-$C_5$, $C_1$-$C_4$, $C_1$-$C_3$, $C_1$-$C_2$, $C_2$-$C_6$, $C_2$-$C_5$, $C_2$-$C_4$, $C_2$-$C_3$, $C_3$-$C_6$, $C_3$-$C_5$, $C_3$-$C_4$, $C_4$-$C_6$, $C_4$-$C_5$, and $C_5$-$C_6$ alkyl.

The following terms are intended to have the meanings presented therewith below and are useful in understanding the description and intended scope of the present invention.

As used herein, "alkyl" refers to a radical of a straight-chain or branched saturated hydrocarbon group having from 1 to 24 carbon atoms ("$C_1$-$C_{24}$ alkyl"). In some embodiments, an alkyl group has 1 to 12 carbon atoms ("$C_1$-$C_{12}$ alkyl"). In some embodiments, an alkyl group has 1 to 8 carbon atoms ("$C_1$-$C_8$ alkyl"). In some embodiments, an alkyl group has 1 to 6 carbon atoms ("$C_1$-$C_6$ alkyl"). In some embodiments, an alkyl group has 2 to 6 carbon atoms ("$C_2$-$C_6$ alkyl"). In some embodiments, an alkyl group has 1 carbon atom ("$C_1$ alkyl"). Examples of $C_1$-$C_6$alkyl groups include methyl ($C_1$), ethyl ($C_2$), n-propyl ($C_3$), isopropyl ($C_3$), n-butyl ($C_4$), tert-butyl ($C_4$), sec-butyl ($C_4$), iso-butyl ($C_4$), n-pentyl ($C_5$), 3-pentanyl ($C_5$), amyl ($C_5$), neopentyl ($C_5$), 3-methyl-2-butanyl ($C_5$), tertiary amyl ($C_5$), and n-hexyl ($C_6$). Additional examples of alkyl groups include n-heptyl ($C_7$), n-octyl ($C_8$) and the like. Each instance of an alkyl group may be independently optionally substituted, i.e., unsubstituted (an "unsubstituted alkyl") or substituted (a "substituted alkyl") with one or more substituents; e.g., for instance from 1 to 5 substituents, 1 to 3 substituents, or 1 substituent. In certain embodiments, the alkyl group is unsubstituted $C_1$-$C_{10}$ alkyl (e.g., —$CH_3$). In certain embodiments, the alkyl group is substituted $C_1$-$C_6$ alkyl.

As used herein, "alkenyl" refers to a radical of a straight-chain or branched hydrocarbon group having from 2 to 24 carbon atoms, one or more carbon-carbon double bonds, and no triple bonds ("$C_2$-$C_{24}$ alkenyl"). In some embodiments, an alkenyl group has 2 to 10 carbon atoms ("$C_2$-$C_{10}$ alkenyl"). In some embodiments, an alkenyl group has 2 to 8 carbon atoms ("$C_2$-$C_8$ alkenyl"). In some embodiments, an alkenyl group has 2 to 6 carbon atoms ("$C_2$-$C_6$ alkenyl"). In some embodiments, an alkenyl group has 2 carbon atoms ("$C_2$ alkenyl"). The one or more carbon-carbon double bonds can be internal (such as in 2-butenyl) or terminal (such as in 1-butenyl). Examples of $C_2$-$C_4$ alkenyl groups include ethenyl ($C_2$), 1-propenyl ($C_3$), 2-propenyl ($C_3$), 1-butenyl ($C_4$), 2-butenyl ($C_4$), butadienyl ($C_4$), and the like. Examples of $C_2$-$C_6$ alkenyl groups include the aforementioned $C_{2-4}$ alkenyl groups as well as pentenyl ($C_5$), pentadienyl ($C_5$), hexenyl ($C_6$), and the like. Additional examples of alkenyl include heptenyl ($C_7$), octenyl ($C_8$), octatrienyl ($C_8$), and the like. Each instance of an alkenyl group may be independently optionally substituted, i.e., unsubstituted (an "unsubstituted alkenyl") or substituted (a "substituted alkenyl") with one or more substituents e.g., for instance from 1 to 5 substituents, 1 to 3 substituents, or 1 substituent. In certain embodiments, the alkenyl group is unsubstituted $C_1$-$C_{10}$ alkenyl. In certain embodiments, the alkenyl group is substituted $C_2$-$C_6$ alkenyl.

As used herein, the term "alkynyl" refers to a radical of a straight-chain or branched hydrocarbon group having from 2 to 24 carbon atoms, one or more carbon-carbon triple bonds ("$C_2$-$C_{24}$ alkenyl"). In some embodiments, an alkynyl group has 2 to 10 carbon atoms ("$C_2$-$C_{10}$ alkynyl"). In some embodiments, an alkynyl group has 2 to 8 carbon atoms ("$C_2$-$C_8$ alkynyl"). In some embodiments, an alkynyl group has 2 to 6 carbon atoms ("$C_2$-$C_6$ alkynyl"). In some embodiments, an alkynyl group has 2 carbon atoms ("$C_2$ alkynyl"). The one or more carbon-carbon triple bonds can be internal (such as in 2-butynyl) or terminal (such as in 1-butynyl). Examples of $C_2$-$C_4$ alkynyl groups include ethynyl ($C_2$), 1-propynyl ($C_3$), 2-propynyl ($C_3$), 1-butynyl ($C_4$), 2-butynyl ($C_4$), and the like. Each instance of an alkynyl group may be independently optionally substituted, i.e., unsubstituted (an "unsubstituted alkynyl") or substituted (a "substituted alkynyl") with one or more substituents e.g., for instance from 1 to 5 substituents, 1 to 3 substituents, or 1 substituent. In certain embodiments, the alkynyl group is unsubstituted $C_{2-10}$ alkynyl. In certain embodiments, the alkynyl group is substituted $C_{2-6}$ alkynyl.

As used herein, the term "haloalkyl," refers to a non-cyclic stable straight or branched chain, or combinations thereof, including at least one carbon atom and at least one halogen selected from the group consisting of F, Cl, Br, and I. The halogen(s) F, Cl, Br, and I may be placed at any position of the haloalkyl group. Exemplary haloalkyl groups include, but are not limited to: —$CF_3$, —$CCl_3$, —$CH_2$—$CF_3$, —$CH_2$—$CCl_3$, —$CH_2$—$CBr_3$, —$CH_2$—$CI_3$, —$CH_2$—$CH_2$—$CH(CF_3)$—$CH_3$, —$CH_2$—$CH_2$—CH(Br)—$CH_3$, and —$CH_2$—CH═CH—$CH_2$—$CF_3$. Each instance of a haloalkyl group may be independently optionally substituted, i.e., unsubstituted (an "unsubstituted haloalkyl") or substituted (a "substituted haloalkyl") with one or more substituents e.g., for instance from 1 to 5 substituents, 1 to 3 substituents, or 1 substituent As used herein, the term "heteroalkyl," refers to a non-cyclic stable straight or branched chain, or combinations thereof, including at least one carbon atom and at least one heteroatom selected from the group consisting of O, N, P, Si, and S, and wherein the nitrogen and sulfur atoms may optionally be oxidized, and the nitrogen heteroatom may optionally be quaternized. The heteroatom(s) O, N, P, S, and Si may be placed at any position of the heteroalkyl group. Exemplary heteroalkyl groups include, but are not limited to: —$CH_2$—$CH_2$—O—$CH_3$, —$CH_2$—$CH_2$—NH—$CH_3$, —$CH_2$—$CH_2$—$N(CH_3)$—$CH_3$, —$CH_2$—S—$CH_2$—$CH_3$, —$CH_2$—$CH_2$, —S(O)—$CH_3$, —$CH_2$—$CH_2$—$S(O)_2$—$CH_3$, —CH═CHO—$CH_3$, —$Si(CH_3)_3$, —$CH_2$—CH═N—$OCH_3$, —CH═CH—$N(CH_3)$—$CH_3$, —O—$CH_3$, and —O—$CH_2$—$CH_3$. Up to two or three heteroatoms may be consecutive, such as, for example, —$CH_2$—NH—$OCH_3$ and —$CH_2$—O—$Si(CH_3)_3$. Where "heteroalkyl" is recited, followed by recitations of specific heteroalkyl groups, such as —$CH_2O$, —$NR^CR^D$, or the like, it will be understood that the terms heteroalkyl and —$CH_2O$ or —$NR^CR^D$ are not redundant or mutually exclusive. Rather, the specific heteroalkyl groups are recited to add clarity. Thus, the term "heteroalkyl" should not be interpreted herein as excluding specific heteroalkyl groups, such as —$CH_2O$, —$NR^CR^D$, or the like. Each instance of a heteroalkyl group may be independently optionally substituted, i.e., unsubstituted (an "unsubstituted heteroalkyl") or substituted (a "substituted heteroalkyl") with one or more substituents e.g., for instance from 1 to 5 substituents, 1 to 3 substituents, or 1 substituent As used herein, "aryl" refers to a radical of a monocyclic or polycyclic (e.g., bicyclic or tricyclic) 4n+2 aromatic ring system (e.g., having 6, 10, or 14 π electrons shared in a cyclic array) having 6-14 ring carbon atoms and zero heteroatoms provided in the aromatic ring system ("$C_6$-$C_{14}$ aryl"). In some embodiments, an aryl group has six ring carbon atoms ("$C_6$ aryl"; e.g., phenyl). In some embodiments, an aryl group has ten ring carbon atoms ("$C_{10}$ aryl"; e.g., naphthyl such as 1-naphthyl and 2-naphthyl). In some embodiments, an aryl group has fourteen ring carbon atoms ("$C_{14}$ aryl"; e.g., anthracyl). An aryl group may be described as, e.g., a $C_6$-$C_{10}$-membered aryl, wherein the term "membered" refers to the non-hydrogen ring atoms within the moiety. Aryl groups include phenyl, naphthyl, indenyl, and tetrahydronaphthyl. Each instance of an aryl group may be independently optionally substituted, i.e., unsubstituted (an "unsubstituted aryl") or substituted (a "substituted aryl") with one or more substituents. In certain embodiments, the aryl group is unsubstituted $C_6$-$C_{14}$ aryl. In certain embodiments, the aryl group is substituted $C_6$-$C_{14}$ aryl.

As used herein, "heteroaryl" refers to a radical of a 5-10 membered monocyclic or bicyclic 4n+2 aromatic ring system (e.g., having 6 or 10 π electrons shared in a cyclic array) having ring carbon atoms and 1-4 ring heteroatoms provided in the aromatic ring system, wherein each heteroatom is independently selected from nitrogen, oxygen and sulfur ("5-10 membered heteroaryl"). In heteroaryl groups that contain one or more nitrogen atoms, the point of attachment can be a carbon or nitrogen atom, as valency permits. Heteroaryl bicyclic ring systems can include one or more heteroatoms in one or both rings. "Heteroaryl" also includes ring systems wherein the heteroaryl ring, as defined above, is fused with one or more aryl groups wherein the point of attachment is either on the aryl or heteroaryl ring, and in such instances, the number of ring members designates the number of ring members in the fused (aryl/heteroaryl) ring system. Bicyclic heteroaryl groups wherein one ring does not contain a heteroatom (e.g., indolyl, quinolinyl, carbazolyl, and the like) the point of attachment can be on either ring, i.e., either the ring bearing a heteroatom (e.g., 2-indolyl) or the ring that does not contain a heteroatom (e.g., 5-indolyl). A heteroaryl group may be described as, e.g., a 6-10-membered heteroaryl, wherein the term "membered" refers to the non-hydrogen ring atoms within the moiety. Each instance of a heteroaryl group may be independently optionally substituted, i.e., unsubstituted (an "unsubstituted heteroaryl") or substituted (a "substituted heteroaryl") with one or more substituents e.g., for instance from 1 to 5 substituents, 1 to 3 substituents, or 1 substituent Exemplary 5-membered heteroaryl groups containing one heteroatom include, without limitation, pyrrolyl, furanyl and thiophenyl. Exemplary 5-membered heteroaryl groups containing two heteroatoms include, without limitation, imidazolyl, pyrazolyl, oxazolyl, isoxazolyl, thiazolyl, and isothiazolyl. Exemplary 5-membered heteroaryl groups containing three heteroatoms include, without limitation, triazolyl, oxadiazolyl, and thiadiazolyl.

Exemplary 5-membered heteroaryl groups containing four heteroatoms include, without limitation, tetrazolyl. Exemplary 6-membered heteroaryl groups containing one heteroatom include, without limitation, pyridinyl. Exemplary 6-membered heteroaryl groups containing two heteroatoms include, without limitation, pyridazinyl, pyrimidinyl, and pyrazinyl. Exemplary 6-membered heteroaryl groups containing three or four heteroatoms include, without limitation, triazinyl and tetrazinyl, respectively. Exemplary 7-membered heteroaryl groups containing one heteroatom include, without limitation, azepinyl, oxepinyl, and thiepinyl. Exemplary 5,6-bicyclic heteroaryl groups include, without limitation, indolyl, isoindolyl, indazolyl, benzotriazolyl, benzothiophenyl, isobenzothiophenyl, benzofuranyl, benzoisofuranyl, benzimidazolyl, benzoxazolyl, benzisoxazolyl, benzoxadiazolyl, benzthiazolyl, benzisothiazolyl, benzthiadiazolyl, indolizinyl, and purinyl. Exemplary 6,6-bicyclic heteroaryl groups include, without limitation, naphthyridinyl, pteridinyl, quinolinyl, isoquinolinyl, cinnolinyl, quinoxalinyl, phthalazinyl, and quinazolinyl. Other exemplary heteroaryl groups include heme and heme derivatives.

As used herein, "cycloalkyl" refers to a radical of a non-aromatic cyclic hydrocarbon group having from 3 to 10 ring carbon atoms ("$C_3$-$C_{10}$ cycloalkyl") and zero heteroatoms in the non-aromatic ring system. In some embodiments, a cycloalkyl group has 3 to 8 ring carbon atoms ("$C_3$-$C_8$ cycloalkyl"). In some embodiments, a cycloalkyl group has 3 to 6 ring carbon atoms ("$C_3$-$C_6$ cycloalkyl"). In some embodiments, a cycloalkyl group has 3 to 6 ring carbon atoms ("$C_3$-$C_6$ cycloalkyl"). In some embodiments, a cycloalkyl group has 5 to 10 ring carbon atoms ("$C_5$-$C_{10}$ cycloalkyl"). A cycloalkyl group may be described as, e.g., a $C_4$-$C_7$-membered cycloalkyl, wherein the term "membered" refers to the non-hydrogen ring atoms within the moiety. Exemplary $C_3$-$C_6$ cycloalkyl groups include, without limitation, cyclopropyl ($C_3$), cyclopropenyl ($C_3$), cyclobutyl ($C_4$), cyclobutenyl ($C_4$), cyclopentyl ($C_5$), cyclopentenyl ($C_5$), cyclohexyl ($C_6$), cyclohexenyl ($C_6$), cyclohexadienyl ($C_6$), and the like. Exemplary $C_3$-$C_8$ cycloalkyl groups include, without limitation, the aforementioned $C_3$-$C_6$ cycloalkyl groups as well as cycloheptyl ($C_7$), cycloheptenyl ($C_7$), cycloheptadienyl ($C_7$), cycloheptatrienyl ($C_7$), cyclooctyl ($C_8$), cyclooctenyl ($C_8$), cubanyl ($C_8$), bicyclo[1.1.1]pentanyl ($C_5$), bicyclo[2.2.2]octanyl ($C_8$), bicyclo [2.1.1]hexanyl ($C_6$), bicyclo[3.1.1]heptanyl ($C_7$), and the like. Exemplary $C_3$-$C_{10}$ cycloalkyl groups include, without limitation, the aforementioned $C_3$-$C_8$ cycloalkyl groups as well as cyclononyl ($C_9$), cyclononenyl ($C_9$), cyclodecyl ($C_{10}$), cyclodecenyl ($C_{10}$), octahydro-1H-indenyl ($C_9$), decahydronaphthalenyl ($C_{10}$), spiro[4.5]decanyl ($C_{10}$), and the like. As the foregoing examples illustrate, in certain embodiments, the cycloalkyl group is either monocyclic ("monocyclic cycloalkyl") or contain a fused, bridged or spiro ring system such as a bicyclic system ("bicyclic cycloalkyl") and can be saturated or can be partially unsaturated. "Cycloalkyl" also includes ring systems wherein the cycloalkyl ring, as defined above, is fused with one or more aryl groups wherein the point of attachment is on the cycloalkyl ring, and in such instances, the number of carbons continue to designate the number of carbons in the cycloalkyl ring system. Each instance of a cycloalkyl group may be independently optionally substituted, i.e., unsubstituted (an "unsubstituted cycloalkyl") or substituted (a "substituted cycloalkyl") with one or more substituents. In certain embodiments, the cycloalkyl group is unsubstituted $C_3$-$C_{10}$ cycloalkyl. In certain embodiments, the cycloalkyl group is a substituted $C_3$-$C_{10}$ cycloalkyl.

"Heterocyclyl" as used herein refers to a radical of a 3- to 10-membered non-aromatic ring system having ring carbon atoms and 1 to 4 ring heteroatoms, wherein each heteroatom is independently selected from nitrogen, oxygen, sulfur, boron, phosphorus, and silicon ("3-10 membered heterocyclyl"). In heterocyclyl groups that contain one or more nitrogen atoms, the point of attachment can be a carbon or nitrogen atom, as valency permits. A heterocyclyl group can either be monocyclic ("monocyclic heterocyclyl") or a fused, bridged or spiro ring system such as a bicyclic system ("bicyclic heterocyclyl"), and can be saturated or can be partially unsaturated. Heterocyclyl bicyclic ring systems can include one or more heteroatoms in one or both rings. "Heterocyclyl" also includes ring systems wherein the heterocyclyl ring, as defined above, is fused with one or more cycloalkyl groups wherein the point of attachment is either on the cycloalkyl or heterocyclyl ring, or ring systems wherein the heterocyclyl ring, as defined above, is fused with one or more aryl or heteroaryl groups, wherein the point of attachment is on the heterocyclyl ring, and in such instances, the number of ring members continue to designate the number of ring members in the heterocyclyl ring system. A heterocyclyl group may be described as, e.g., a 3-7-membered heterocyclyl, wherein the term "membered" refers to the non-hydrogen ring atoms, i.e., carbon, nitrogen, oxygen, sulfur, boron, phosphorus, and silicon, within the moiety. Each instance of heterocyclyl may be independently optionally substituted, i.e., unsubstituted (an "unsubstituted heterocyclyl") or substituted (a "substituted heterocyclyl") with one or more substituents. In certain embodiments, the heterocyclyl group is unsubstituted 3-10 membered heterocyclyl. In certain embodiments, the heterocyclyl group is substituted 3-10 membered heterocyclyl.

Exemplary 3-membered heterocyclyl groups containing one heteroatom include, without limitation, azirdinyl, oxiranyl, thiorenyl. Exemplary 4-membered heterocyclyl groups containing one heteroatom include, without limitation, azetidinyl, oxetanyl and thietanyl. Exemplary 5-membered heterocyclyl groups containing one heteroatom include, without limitation, tetrahydrofuranyl, dihydrofuranyl, tetrahydrothiophenyl, dihydrothiophenyl, pyrrolidinyl, dihydropyrrolyl and pyrrolyl-2,5-dione. Exemplary 5-membered heterocyclyl groups containing two heteroatoms include, without limitation, dioxolanyl, oxasulfuranyl, disulfuranyl, and oxazolidin-2-one. Exemplary 5-membered heterocyclyl groups containing three heteroatoms include, without limitation, triazolinyl, oxadiazolinyl, and thiadiazolinyl. Exemplary 6-membered heterocyclyl groups containing one heteroatom include, without limitation, piperidinyl (e.g., 2,2,6,6-tetramethylpiperidinyl), tetrahydropyranyl, dihydropyridinyl, pyridinonyl (e.g., 1-methylpyridin2-onyl), and thianyl. Exemplary 6-membered heterocyclyl groups containing two heteroatoms include, without limitation, piperazinyl, morpholinyl, pyridazinonyl (2-methylpyridazin-3-onyl), pyrimidinonyl (e.g., 1-methylpyrimidin-2-onyl, 3-methylpyrimidin-4-onyl), dithianyl, dioxanyl. Exemplary 6-membered heterocyclyl groups containing two heteroatoms include, without limitation, triazinanyl. Exemplary 7-membered heterocyclyl groups containing one heteroatom include, without limitation, azepanyl, oxepanyl and thiepanyl. Exemplary 8-membered heterocyclyl groups containing one heteroatom include, without limitation, azocanyl, oxecanyl and thiocanyl. Exemplary 5-membered heterocyclyl groups fused to a $C_6$ aryl ring (also referred to herein as a 5,6-bicyclic heterocyclyl ring) include, without limitation, indolinyl, isoindolinyl, dihydrobenzofuranyl, dihydrobenzothienyl, benzoxazolinonyl, and the like. Exemplary 5-membered heterocyclyl groups fused to a heterocyclyl ring (also referred to herein as a 5,5-bicyclic heterocyclyl ring) include, without limitation, octahydropyrrolopyrrolyl (e.g., octahydropyrrolo[3,4-c]pyrrolyl), and the like. Exemplary 6-membered heterocyclyl groups fused to a heterocyclyl ring (also referred to as a 4,6-membered heterocyclyl ring) include, without limitation, diazaspirononanyl (e.g., 2,7-diazaspiro[3.5]nonanyl). Exemplary 6-membered heterocyclyl groups fused to an aryl ring (also referred to herein as a 6,6-bicyclic heterocyclyl ring) include, without limitation, tetrahydroquinolinyl, tetrahydroisoquinolinyl, and the like. Exemplary 6-membered heterocyclyl groups fused to a cycloalkyl ring (also referred to herein as a 6,7-bicyclic heterocyclyl ring) include, without limitation, azabicyclooctanyl (e.g., (1,5)-8-azabicyclo[3.2.1]octanyl). Exemplary 6-membered heterocyclyl groups fused to a cycloalkyl ring (also referred to herein as a 6,8-bicyclic heterocyclyl ring) include, without limitation, azabicyclononanyl (e.g., 9-azabicyclo[3.3.1]nonanyl).

The terms "alkylene," "alkenylene," "alkynylene," "haloalkylene," "heteroalkylene," "cycloalkylene," or "heterocyclylene," alone or as part of another substituent, mean, unless otherwise stated, a divalent radical derived from an alkyl, alkenyl, alkynyl, haloalkylene, heteroalkylene, cycloalkyl, or heterocyclyl respectively. For example, the term "alkenylene," by itself or as part of another substituent, means, unless otherwise stated, a divalent radical derived from an alkene. An alkylene, alkenylene, alkynylene, haloalkylene, heteroalkylene, cycloalkylene, or heterocyclylene group may be described as, e.g., a $C_1$-$C_6$-membered alkylene, $C_2$-$C_6$-membered alkenylene, $C_2$-$C_6$-membered alkynylene, $C_1$-$C_6$-membered haloalkylene, $C_1$-$C_6$-membered heteroalkylene, $C_3$-$C_8$-membered cycloalkylene, or $C_3$-$C_8$-membered heterocyclylene, wherein the term "membered" refers to the non-hydrogen atoms within the moiety. In the case of heteroalkylene and heterocyclylene groups, heteroatoms can also occupy either or both of the chain termini (e.g., alkyleneoxy, alkylenedioxy, alkyleneamino, alkylenediamino, and the like). Still further, no orientation of the linking group is implied by the direction in which the formula of the linking group is written. For example, the formula —$C(O)_2R'$— may represent both —$C(O)_2R'$- and —$R'C(O)_2$—.

As used herein, the terms "cyano" or "—CN" refer to a substituent having a carbon atom joined to a nitrogen atom by a triple bond, e.g., C≡N.

As used herein, the terms "halogen" or "halo" refer to fluorine, chlorine, bromine or iodine.

As used herein, the term "hydroxy" refers to —OH.

As used herein, the term "nitro" refers to a substitutent having two oxygen atoms bound to a nitrogen atom, e.g., —$NO_2$.

As used herein, the term "nucleobase" as used herein, is a nitrogen-containing biological compounds found linked to a sugar within a nucleoside—the basic building blocks of deoxyribonucleic acid (DNA) and ribonucleic acid (RNA). The primary, or naturally occurring, nucleobases are cytosine (DNA and RNA), guanine (DNA and RNA), adenine (DNA and RNA), thymine (DNA) and uracil (RNA), abbreviated as C, G, A, T, and U, respectively. Because A, G, C, and T appear in the DNA, these molecules are called DNA-bases; A, G, C, and U are called RNA-bases. Adenine and guanine belong to the double-ringed class of molecules called purines (abbreviated as R). Cytosine, thymine, and uracil are all pyrimidines. Other nucleobases that do not function as normal parts of the genetic code, are termed non-naturally occurring. In an embodiment, a nucleobase may be chemically modified, for example, with an alkyl (e.g., methyl), halo, —O-alkyl, or other modification.

As used herein, the term "nucleic acid" refers to deoxyribonucleic acids (DNA) or ribonucleic acids (RNA) and polymers thereof in either single- or double-stranded form. The term "nucleic acid" includes a gene, cDNA, pre-mRNA, or an mRNA. In one embodiment, the nucleic acid molecule is synthetic (e.g., chemically synthesized) or recombinant. Unless specifically limited, the term encompasses nucleic acids containing analogues or derivatives of natural nucleotides that have similar binding properties as the reference nucleic acid and are metabolized in a manner similar to naturally occurring nucleotides. Unless otherwise indicated, a particular nucleic acid sequence also implicitly encompasses conservatively modified variants thereof (e.g., degenerate codon substitutions), alleles, orthologs, SNPs, and complementarity sequences as well as the sequence explicitly indicated.

As used herein, "oxo" refers to a carbonyl, i.e., —C(O)—.

The symbol "∿∿" as used herein in relation to a compound of Formula (I) refers to an attachment point to another moiety or functional group within the compound.

Alkyl, alkenyl, alkynyl, haloalkyl, heteroalkyl, cycloalkyl, heterocyclyl, aryl, and heteroaryl groups, as defined herein, are optionally substituted. In general, the term "substituted", whether preceded by the term "optionally" or not, means that at least one hydrogen present on a group (e.g., a carbon or nitrogen atom) is replaced with a permissible substituent, e.g., a substituent which upon substitution results in a stable compound, e.g., a compound which does not spontaneously undergo transformation such as by rearrangement, cyclization, elimination, or other reaction. Unless otherwise indicated, a "substituted" group has a substituent at one or more substitutable positions of the group, and when more than one position in any given structure is substituted, the substituent is either the same or different at each position. The term "substituted" is contemplated to include substitution with all permissible substituents of organic compounds, such as any of the substituents described herein that result in the formation of a stable compound. The present disclosure contemplates any and all such combinations in order to arrive at a stable compound. For purposes of this invention, heteroatoms such as nitrogen may have hydrogen substituents and/or any suitable substituent as described herein which satisfy the valencies of the heteroatoms and results in the formation of a stable moiety.

Two or more substituents may optionally be joined to form aryl, heteroaryl, cycloalkyl, or heterocyclyl groups. Such so-called ring-forming substituents are typically, though not necessarily, found attached to a cyclic base structure. In one embodiment, the ring-forming substituents are attached to adjacent members of the base structure. For example, two ring-forming substituents attached to adjacent members of a cyclic base structure create a fused ring structure. In another embodiment, the ring-forming substituents are attached to a single member of the base structure. For example, two ring-forming substituents attached to a single member of a cyclic base structure create a spirocyclic structure. In yet another embodiment, the ring-forming substituents are attached to non-adjacent members of the base structure.

The compounds provided herein may exist in one or more particular geometric, optical, enantiomeric, diasteriomeric, epimeric, stereoisomeric, tautomeric, conformational, or anomeric forms, including but not limited to: cis- and trans-forms; E- and Z-forms; endo- and exo-forms; R-, S-, and meso-forms; D- and L-forms; d- and l-forms; (+) and (−) forms; keto-, enol-, and enolate-forms; syn- and anti-forms; synclinal- and anticlinal-forms; α- and β-forms; axial and equatorial forms; boat-, chair-, twist-, envelope-, and half chair-forms; and combinations thereof, hereinafter collectively referred to as “isomers” (or “isomeric forms”).

Compounds described herein can comprise one or more asymmetric centers, and thus can exist in various isomeric forms, e.g., enantiomers and/or diastereomers. For example, the compounds described herein can be in the form of an individual enantiomer, diastereomer or geometric isomer, or can be in the form of a mixture of stereoisomers, including racemic mixtures and mixtures enriched in one or more stereoisomer. In an embodiment, the stereochemistry depicted in a compound is relative rather than absolute. Isomers can be isolated from mixtures by methods known to those skilled in the art, including chiral high-pressure liquid chromatography (HPLC) and the formation and crystallization of chiral salts; or preferred isomers can be prepared by asymmetric syntheses. See, for example, Jacques et al., *Enantiomers, Racemates and Resolutions* (Wiley Interscience, New York, 1981); Wilen et al., Tetrahedron 33:2725 (1977); Eliel, Stereochemistry of Carbon Compounds (McGraw-Hill, NY, 1962); and Wilen, *Tables of Resolving Agents and Optical Resolutions* p. 268 (E. L. Eliel, Ed., Univ. of Notre Dame Press, Notre Dame, IN 1972). This disclosure additionally encompasses compounds described herein as individual isomers substantially free of other isomers, and alternatively, as mixtures of various isomers.

As used herein, a pure enantiomeric compound is substantially free from other enantiomers or stereoisomers of the compound (i.e., in enantiomeric excess). In other words, an “S” form of the compound is substantially free from the “R” form of the compound and is, thus, in enantiomeric excess of the “R” form. The term “enantiomerically pure” or “pure enantiomer” denotes that the compound comprises more than 75% by weight, more than 80% by weight, more than 85% by weight, more than 90% by weight, more than 91% by weight, more than 92% by weight, more than 93% by weight, more than 94% by weight, more than 95% by weight, more than 96% by weight, more than 97% by weight, more than 98% by weight, more than 99% by weight, more than 99.5% by weight, or more than 99.9% by weight, of the enantiomer. In certain embodiments, the weights are based upon total weight of all enantiomers or stereoisomers of the compound.

In the compositions provided herein, an enantiomerically pure compound can be present with other active or inactive ingredients. For example, a pharmaceutical composition comprising an enantiomerically pure R-compound can comprise, for example, about 90% excipient and about 10% enantiomerically pure R-compound. In certain embodiments, the enantiomerically pure R-compound in such compositions can, for example, comprise, at least about 95% by weight R-compound and at most about 5% by weight S-compound, by total weight of the compound. For example, a pharmaceutical composition comprising an enantiomerically pure S-compound can comprise, for example, about 90% excipient and about 10% enantiomerically pure S-compound. In certain embodiments, the enantiomerically pure S-compound in such compositions can, for example, comprise, at least about 95% by weight S-compound and at most about 5% by weight R-compound, by total weight of the compound.

In some embodiments, a diastereomerically pure compound can be present with other active or inactive ingredients. For example, a pharmaceutical composition comprising a diastereometerically pure exo compound can comprise, for example, about 90% excipient and about 10% diastereometerically pure exo compound. In certain embodiments, the diastereometerically pure exo compound in such compositions can, for example, comprise, at least about 95% by weight exo compound and at most about 5% by weight endo compound, by total weight of the compound. For example, a pharmaceutical composition comprising a diastereometerically pure endo compound can comprise, for example, about 90% excipient and about 10% diastereometerically pure endo compound. In certain embodiments, the diastereometerically pure endo compound in such compositions can, for example, comprise, at least about 95% by weight endo compound and at most about 5% by weight exo compound, by total weight of the compound.

In some embodiments, an isomerically pure compound can be present with other active or inactive ingredients. For example, a pharmaceutical composition comprising a isomerically pure exo compound can comprise, for example, about 90% excipient and about 10% isomerically pure exo compound. In certain embodiments, the isomerically pure exo compound in such compositions can, for example, comprise, at least about 95% by weight exo compound and at most about 5% by weight endo compound, by total weight of the compound. For example, a pharmaceutical composition comprising an isomerically pure endo compound can comprise, for example, about 90% excipient and about 10% isomerically pure endo compound. In certain embodiments, the isomerically pure endo compound in such compositions can, for example, comprise, at least about 95% by weight endo compound and at most about 5% by weight exo compound, by total weight of the compound.

In certain embodiments, the active ingredient can be formulated with little or no excipient or carrier.

Compound described herein may also comprise one or more isotopic substitutions. For example, H may be in any isotopic form, including $^{1}H$, $^{2}H$ (D or deuterium), and $^{3}H$ (T or tritium); C may be in any isotopic form, including $^{12}C$, $^{13}C$, and $^{14}C$; O may be in any isotopic form, including $^{16}O$ and $^{18}O$; N may be in any isotopic form, including $^{14}N$ and $^{15}N$; F may be in any isotopic form, including $^{18}F$, $^{19}F$, and the like.

The term “pharmaceutically acceptable salt” is meant to include salts of the active compounds that are prepared with relatively nontoxic acids or bases, depending on the particular substituents found on the compounds described herein. When compounds of the present disclosure contain relatively acidic functionalities, base addition salts can be obtained by contacting the neutral form of such compounds with a sufficient amount of the desired base, either neat or in a suitable inert solvent. Examples of pharmaceutically acceptable base addition salts include sodium, potassium, calcium, ammonium, organic amino, or magnesium salt, or a similar salt. When compounds of the present invention contain relatively basic functionalities, acid addition salts can be obtained by contacting the neutral form of such compounds with a sufficient amount of the desired acid, either neat or in a suitable inert solvent. Examples of pharmaceutically acceptable acid addition salts include those derived from inorganic acids like hydrochloric, hydrobromic, nitric, carbonic, monohydrogencarbonic, phosphoric, monohydrogenphosphoric, dihydrogenphosphoric, sulfuric, monohydrogensulfuric, hydriodic, or phosphorous acids and the like, as well as the salts derived from organic acids like acetic, propionic, isobutyric, maleic, malonic, benzoic, succinic, suberic, fumaric, lactic, mandelic, phthalic, benzenesulfonic, p-tolylsulfonic, citric, tartaric, methanesulfonic, and the like. Also included are salts of amino acids such as arginate and the like, and salts of organic acids like glucuronic or galactunoric acids and the like (see, e.g., Berge et al, *Journal of Pharmaceutical Science* 66: 1-19 (1977)). Certain specific compounds of the present invention contain both basic and acidic functionalities that allow the compounds to be converted into either base or acid addition salts. These salts may be prepared by methods known to those skilled in the art. Other pharmaceutically acceptable carriers known to those of skill in the art are suitable for the present invention.

In addition to salt forms, the present disclosure provides compounds in a prodrug form. Prodrugs of the compounds described herein are those compounds that readily undergo chemical changes under physiological conditions to provide the compounds of the present invention. Additionally, prodrugs can be converted to the compounds of the present invention by chemical or biochemical methods in an ex vivo environment. For example, prodrugs can be slowly converted to the compounds of the present invention when placed in a transdermal patch reservoir with a suitable enzyme or chemical reagent.

The term "solvate" refers to forms of the compound that are associated with a solvent, usually by a solvolysis reaction. This physical association may include hydrogen bonding. Conventional solvents include water, methanol, ethanol, acetic acid, DMSO, THF, diethyl ether, and the like. The compounds of Formula (I) may be prepared, e.g., in crystalline form, and may be solvated. Suitable solvates include pharmaceutically acceptable solvates and further include both stoichiometric solvates and non-stoichiometric solvates. In certain instances, the solvate will be capable of isolation, for example, when one or more solvent molecules are incorporated in the crystal lattice of a crystalline solid. "Solvate" encompasses both solution-phase and isolable solvates. Representative solvates include hydrates, ethanolates, and methanolates.

The term "hydrate" refers to a compound which is associated with water. Typically, the number of the water molecules contained in a hydrate of a compound is in a definite ratio to the number of the compound molecules in the hydrate. Therefore, a hydrate of a compound may be represented, for example, by the general formula $R \cdot x\ H_2O$, wherein R is the compound and wherein x is a number greater than 0. A given compound may form more than one type of hydrates, including, e.g., monohydrates (x is 1), lower hydrates (x is a number greater than 0 and smaller than 1, e.g., hemihydrates ($R \cdot 0.5\ H_2O$)), and polyhydrates (x is a number greater than 1, e.g., dihydrates ($R \cdot 2\ H_2O$) and hexahydrates ($R \cdot 6\ H_2O$)).

The term "tautomer" refers to compounds that are interchangeable forms of a particular compound structure, and that vary in the displacement of hydrogen atoms and electrons. Thus, two structures may be in equilibrium through the movement of $\pi$ electrons and an atom (usually H). For example, enols and ketones are tautomers because they are rapidly interconverted by treatment with either acid or base. Another example of tautomerism is the aci- and nitro-forms of phenylnitromethane that are likewise formed by treatment with acid or base. Tautomeric forms may be relevant to the attainment of the optimal chemical reactivity and biological activity of a compound of interest.

Other Definitions

The following definitions are more general terms used throughout the present disclosure.

The articles "a" and "an" refer to one or more than one (e.g., to at least one) of the grammatical object of the article. By way of example, "an element" means one element or more than one element. The term "and/or" means either "and" or "or" unless indicated otherwise.

The term "about" is used herein to mean within the typical ranges of tolerances in the art. For example, "about" can be understood as about 2 standard deviations from the mean. In certain embodiments, about means±10%. In certain embodiments, about means±5%. When about is present before a series of numbers or a range, it is understood that "about" can modify each of the numbers in the series or range.

"Acquire" or "acquiring" as used herein, refer to obtaining possession of a value, e.g., a numerical value, or image, or a physical entity (e.g., a sample), by "directly acquiring" or "indirectly acquiring" the value or physical entity. "Directly acquiring" means performing a process (e.g., performing an analytical method or protocol) to obtain the value or physical entity. "Indirectly acquiring" refers to receiving the value or physical entity from another party or source (e.g., a third-party laboratory that directly acquired the physical entity or value). Directly acquiring a value or physical entity includes performing a process that includes a physical change in a physical substance or the use of a machine or device. Examples of directly acquiring a value include obtaining a sample from a human subject. Directly acquiring a value includes performing a process that uses a machine or device, e.g., mass spectrometer to acquire mass spectrometry data.

The terms "administer," "administering," or "administration," as used herein refers to implanting, absorbing, ingesting, injecting, inhaling, or otherwise introducing an inventive compound, or a pharmaceutical composition thereof.

As used herein, the terms "condition," "disease," and "disorder" are used interchangeably.

An "effective amount" of a compound of Formula (I) refers to an amount sufficient to elicit the desired biological response, i.e., treating the condition. As will be appreciated by those of ordinary skill in this art, the effective amount of a compound of Formula (I) may vary depending on such factors as the desired biological endpoint, the pharmacokinetics of the compound, the condition being treated, the mode of administration, and the age and health of the subject. An effective amount encompasses therapeutic and prophylactic treatment. For example, in treating cancer, an effective amount of an inventive compound may reduce the tumor burden or stop the growth or spread of a tumor.

A "therapeutically effective amount" of a compound of Formula (I) is an amount sufficient to provide a therapeutic benefit in the treatment of a condition or to delay or minimize one or more symptoms associated with the condition. In some embodiments, a therapeutically effective amount is an amount sufficient to provide a therapeutic benefit in the treatment of a condition or to minimize one or more symptoms associated with the condition. A therapeutically effective amount of a compound means an amount of therapeutic agent, alone or in combination with other therapies, which provides a therapeutic benefit in the treatment of the condition. The term "therapeutically effective amount" can encompass an amount that improves overall therapy, reduces or avoids symptoms or causes of the condition, or enhances the therapeutic efficacy of another therapeutic agent.

The terms "peptide," "polypeptide," and "protein" are used interchangeably, and refer to a compound comprised of amino acid residues covalently linked by peptide bonds. A protein or peptide must contain at least two amino acids, and no limitation is placed on the maximum number of amino acids that can comprised therein. Polypeptides include any peptide or protein comprising two or more amino acids joined to each other by peptide bonds. As used herein, the term refers to both short chains, which also commonly are referred to in the art as peptides, oligopeptides and oligomers, for example, and to longer chains, which generally are referred to in the art as proteins, of which there are many types.

"Prevention," "prevent," and "preventing" as used herein refers to a treatment that comprises administering a therapy, e.g., administering a compound described herein (e.g., a compound of Formula (I)) prior to the onset of a disease, disorder, or condition in order to preclude the physical manifestation of said disease, disorder, or condition. In some embodiments, "prevention," "prevent," and "preventing" require that signs or symptoms of the disease, disorder, or condition have not yet developed or have not yet been observed. In some embodiments, treatment comprises prevention and in other embodiments it does not.

A "subject" to which administration is contemplated includes, but is not limited to, humans (i.e., a male or female of any age group, e.g., a pediatric subject (e.g., infant, child, adolescent) or adult subject (e.g., young adult, middle-aged adult, or senior adult)) and/or other non-human animals, for example, mammals (e.g., primates (e.g., cynomolgus monkeys, rhesus monkeys); commercially relevant mammals such as cattle, pigs, horses, sheep, goats, cats, and/or dogs) and birds (e.g., commercially relevant birds such as chickens, ducks, geese, and/or turkeys). In certain embodiments, the animal is a mammal. The animal may be a male or female and at any stage of development. A non-human animal may be a transgenic animal.

As used herein, the terms "treatment," "treat," and "treating" refer to reversing, alleviating, delaying the onset of, or inhibiting the progress of one or more of a symptom, manifestation, or underlying cause of a disease, disorder, or condition (e.g., as described herein), e.g., by administering a therapy, e.g., administering a compound described herein (e.g., a compound of Formula (I)). In an embodiment, treating comprises reducing, reversing, alleviating, delaying the onset of, or inhibiting the progress of a symptom of a disease, disorder, or condition. In an embodiment, treating comprises reducing, reversing, alleviating, delaying the onset of, or inhibiting the progress of a manifestation of a disease, disorder, or condition. In an embodiment, treating comprises reducing, reversing, alleviating, reducing, or delaying the onset of, an underlying cause of a disease, disorder, or condition. In some embodiments, "treatment," "treat," and "treating" require that signs or symptoms of the disease, disorder, or condition have developed or have been observed. In other embodiments, treatment may be administered in the absence of signs or symptoms of the disease or condition, e.g., in preventive treatment. For example, treatment may be administered to a susceptible individual prior to the onset of symptoms (e.g., in light of a history of symptoms and/or in light of genetic or other susceptibility factors). Treatment may also be continued after symptoms have resolved, for example, to delay or prevent recurrence. Treatment may also be continued after symptoms have resolved, for example, to delay or prevent recurrence. In some embodiments, treatment comprises prevention and in other embodiments it does not.

A "proliferative disease" refers to a disease that occurs due to abnormal extension by the multiplication of cells (Walker, *Cambridge Dictionary of Biology*; Cambridge University Press: Cambridge, UK, 1990). A proliferative disease may be associated with: 1) the pathological proliferation of normally quiescent cells; 2) the pathological migration of cells from their normal location (e.g., metastasis of neoplastic cells); 3) the pathological expression of proteolytic enzymes such as the matrix metalloproteinases (e.g., collagenases, gelatinases, and elastases); 4) the pathological angiogenesis as in proliferative retinopathy and tumor metastasis; or 5) evasion of host immune surveillance and elimination of neoplastic cells. Exemplary proliferative diseases include cancers (i.e., "malignant neoplasms"), benign neoplasms, and angiogenesis.

A "non-proliferative disease" refers to a disease that does not primarily extend through the abnormal multiplication of cells. A non-proliferative disease may be associated with any cell type or tissue type in a subject. Exemplary non-proliferative diseases include neurological diseases or disorders (e.g., a repeat expansion disease); autoimmune disease or disorders; immunodeficiency diseases or disorders; lysosomal storage diseases or disorders; inflammatory diseases or disorders; cardiovascular conditions, diseases, or disorders; metabolic diseases or disorders; respiratory conditions, diseases, or disorders; renal diseases or disorders; and infectious diseases.

Compounds

The present disclosure features a compound of Formula (I):

(I)

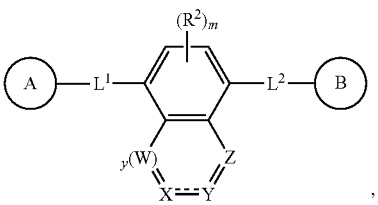

, or a pharmaceutically acceptable salt, solvate, hydrate, tautomer, or stereoisomer thereof, wherein A and B are each independently cycloalkyl, heterocyclyl, aryl, or heteroaryl, each of which is optionally substituted with one or more $R^1$;

W is N, C, or $C(R^{3a})$; X, Y, and Z are each independently $C(R^{3a})$, $C(R^{3a})(R^{3b})$, N, $N(R^{3c})$, or O, wherein the bonds in the ring comprising X, Y, and Z may be single or double bonds as valency permits; $L^1$ and $L^2$ are each independently absent, $C_1$-$C_6$-alkylene, $C_1$-$C_6$-heteroalkylene, —O—, —C(O)—, —$N(R^4)$—, —$N(R^4)C(O)$—, or —$C(O)N(R^4)$—, wherein each alkylene and heteroalkylene is optionally substituted with one or more $R^5$; each $R^1$ is independently hydrogen, $C_1$-$C_6$-alkyl, $C_2$-$C_6$-alkenyl, $C_2$-$C_6$-alkynyl, $C_1$-$C_6$-heteroalkyl, $C_1$-$C_6$-haloalkyl, cycloalkyl, heterocyclyl, aryl, $C_1$-$C_6$alkylene-aryl, $C_1$-$C_6$ alkenylene-aryl, $C_1$-$C_6$ alkylene-heteroaryl, heteroaryl, halo, cyano, oxo, —$OR^A$, —$NR^BR^C$, —$NR^BC(O)R^D$, —$NO_2$, —$C(O)NR^BR^C$, —$C(O)R^D$, —$C(O)OR^D$, —$SR^E$, or —$S(O)_xR^D$, wherein each alkyl, alkylene, alkenyl, alkynyl, heteroalkyl, haloalkyl, cycloalkyl, heterocyclyl, aryl, and heteroaryl is optionally substituted with one or more $R^6$; or two $R^1$ groups, together with the atoms to which they are attached, form a 3-7-membered cycloalkyl, heterocyclyl, aryl, or heteroaryl, wherein each cycloalkyl, heterocyclyl, aryl, and heteroaryl is optionally substituted with one or more $R^6$; each $R^2$ is independently hydrogen, $C_1$-$C_6$-alkyl, $C_2$-$C_6$-alkenyl, $C_2$-$C_6$-alkynyl, $C_1$-$C_6$-heteroalkyl, $C_1$-$C_6$-haloalkyl, halo, cyano, or —$OR^A$; $R^{3a}$ and $R^{3b}$ are each independently hydrogen, $C_1$-$C_6$-alkyl, $C_1$-$C_6$-heteroalkyl, $C_1$-$C_6$-haloalkyl, halo, cyano, —$OR^A$, —$NR^BR^C$, —$C(O)R^D$, or —$C(O)OR^D$; or each of $R^{3a}$ and $R^{3b}$, together with the carbon atom to which they are attached, form an oxo group; $R^{3c}$ is hydrogen or $C_1$-$C_6$-alkyl; each $R^4$ is independently hydrogen, $C_1$-$C_6$-alkyl, or $C_1$-$C_6$-haloalkyl; each $R^5$ is independently hydrogen, $C_1$-$C_6$-alkyl, $C_1$-$C_6$-heteroalkyl, $C_1$-$C_6$-haloalkyl, cycloalkyl, halo, cyano, oxo, —$OR^A$, —$NR^BR^C$, —$C(O)R^D$, or —$C(O)OR^D$; each $R^6$ is independently $C_1$-$C_6$-alkyl, $C_2$-$C_6$-alkenyl, $C_2$-$C_6$-alkynyl, $C_1$-$C_6$-heteroalkyl, $C_1$-$C_6$-haloalkyl, cycloalkyl, heterocyclyl, aryl, heteroaryl, halo, cyano, oxo, —$OR^A$, —$NR^BR^C$, —$NR^BC(O)R^D$, —$NO_2$, —$C(O)NR^BR^C$, —$C(O)R^D$, —$C(O)OR^D$, —$SR^E$, or —$S(O)_xR^D$, wherein each alkyl, alkenyl, alkynyl, heteroalkyl, haloalkyl, cycloalkyl, heterocyclyl, aryl, and heteroaryl is optionally substituted with one or more $R^{11}$; each $R^7$ is $C_1$-$C_6$-alkyl, halo, cyano, oxo, or —$OR^{A1}$; each $R^{11}$ is independently $C_1$-$C_6$-alkyl, $C_1$-$C_6$-heteroalkyl, $C_1$-$C_6$-haloalkyl, cycloalkyl, heterocyclyl, aryl, heteroaryl, halo, cyano, oxo, or —$OR^A$; each $R^A$ is independently hydrogen, $C_1$-$C_6$ alkyl, $C_1$-$C_6$ haloalkyl, aryl, heteroaryl, $C_1$-$C_6$ alkylene-aryl, $C_1$-$C_6$ alkylene-heteroaryl, —$C(O)R^D$, or —$S(O)_xR^D$; each of $R^B$ and $R^C$ is independently hydrogen, $C_1$-$C_6$ alkyl, $C_1$-$C_6$ heteroalkyl, cycloalkyl, heterocyclyl, or —$OR^A$; or $R^B$ and $R^C$ together with the atom to which they are attached form a 3-7-membered heterocyclyl ring optionally substituted with one or more $R^7$; each $R^D$ and $R^E$ is independently hydrogen, $C_1$-$C_6$ alkyl, $C_2$-$C_6$ alkenyl, $C_2$-$C_6$ alkynyl, $C_1$-$C_6$ heteroalkyl, $C_1$-$C_6$ haloalkyl, cycloalkyl, heterocyclyl, aryl, heteroaryl, $C_1$-$C_6$ alkylene-aryl, or $C_1$-$C_6$ alkylene-heteroaryl; each $R^{A1}$ is hydrogen or $C_1$-$C_6$-alkyl; m is 0, 1, or 2; x is 0, 1, or 2; and y is 0 or 1.

As generally described herein, A and B, are each independently cycloalkyl, heterocyclyl, aryl, or heteroaryl, each of which is optionally substituted with one or more $R^1$.

In some embodiments, each of A and B are independently a monocyclic ring, e.g., monocyclic cycloalkyl, monocyclic heterocyclyl, monocyclic aryl, or monocyclic heteroaryl. The monocyclic ring may be saturated, partially unsaturated, or fully unsaturated (e.g., aromatic). In some embodiments, A or B are independently a monocyclic ring comprising between 3 and 10 ring atoms (e.g., 3, 4, 5, 6, 7, 8, 9, or 10 ring atoms). In some embodiments, A is a 4-membered monocyclic ring. In some embodiments, B is a 4-membered monocyclic ring. In some embodiments, A is a 5-membered monocyclic ring. In some embodiments, B is a 5-membered monocyclic ring. In some embodiments, A is a 6-membered monocyclic ring. In some embodiments, B is a 6-membered monocyclic ring. In some embodiments, A is a 7-membered monocyclic ring. In some embodiments, B is a 7-membered monocyclic ring. In some embodiments, A is an 8-membered monocyclic ring. In some embodiments, B is an 8-membered monocyclic ring. In some embodiments, A or B are independently a monocyclic ring optionally substituted with one or more $R^1$.

In some embodiments, A or B are independently a bicyclic ring, e.g., bicyclic cycloalkyl, bicyclic heterocyclyl, bicyclic aryl, or bicyclic heteroaryl. The bicyclic ring may be saturated, partially unsaturated, or fully unsaturated (e.g., aromatic). In some embodiments, A or B are independently a bicyclic ring comprising a fused, bridged, or spiro ring system. In some embodiments, A or B are independently a bicyclic ring comprising between 4 and 18 ring atoms (e.g., 4, 5, 6, 7, 8, 9, 10, 11, 12, 13, 14, 15, 16, 17, or 18 ring atoms). In some embodiments, A is a 6-membered bicyclic ring. In some embodiments, B is a 6-membered bicyclic ring. In some embodiments, A is a 7-membered bicyclic ring. In some embodiments, B is a 7-membered bicyclic ring. In some embodiments, A is an 8-membered bicyclic ring. In some embodiments, B is an 8-membered bicyclic ring. In some embodiments, A is a 9-membered bicyclic ring. In some embodiments, B is a 9-membered bicyclic ring. In some embodiments, A is a 10-membered bicyclic ring. In some embodiments, B is a 10-membered bicyclic ring. In some embodiments, A is an 11-membered bicyclic ring. In some embodiments, B is an 11-membered bicyclic ring. In some embodiments, A is a 12-membered bicyclic ring. In some embodiments, B is a 12-membered bicyclic ring. In some embodiments, A or B are independently a bicyclic ring optionally substituted with one or more $R^1$.

In some embodiments, A or B are independently a tricyclic ring, e.g., tricyclic cycloalkyl, tricyclic heterocyclyl, tricyclic aryl, or tricyclic heteroaryl. The tricyclic ring may be saturated, partially unsaturated, or fully unsaturated (e.g., aromatic). In some embodiments, A or B are independently a tricyclic ring that comprises a fused, bridged, or spiro ring system, or a combination thereof. In some embodiments, A or B are independently a tricyclic ring comprising between 6 and 24 ring atoms (e.g., 6, 7, 8, 9, 10, 11, 12, 13, 14, 15, 16, 17, 18, 19, 20, 21, 22, 23, or 24 ring atoms). In some embodiments, A is an 8-membered tricyclic ring. In some embodiments, B is an 8-membered tricyclic ring. In some embodiments, A is a 9-membered tricyclic ring. In some embodiments, B is a 9-membered tricyclic ring. In some embodiments, A is a 10-membered tricyclic ring. In some embodiments, B is a 10-membered tricyclic ring. In some embodiments, A or B are independently a tricyclic ring optionally substituted with one or more $R^1$.

In some embodiments, A or B are independently monocyclic cycloalkyl, monocyclic heterocyclyl, monocyclic aryl, or monocyclic heteroaryl. In some embodiments, A or B are independently bicyclic cycloalkyl, bicyclic heterocyclyl, bicyclic aryl, or bicyclic heteroaryl. In some embodiments, A or B are independently tricyclic cycloalkyl, tricyclic heterocyclyl, tricyclic aryl, or tricyclic heteroaryl. In some embodiments, A is monocyclic heterocyclyl. In some embodiments, B is monocyclic heterocyclyl. In some embodiments, A is bicyclic heterocyclyl. In some embodiments, B is bicyclic heterocyclyl. In some embodiments, A is monocyclic heteroaryl. In some embodiments, B is monocyclic heteroaryl. In some embodiments, A is bicyclic heteroaryl. In some embodiments, B is bicyclic heteroaryl.

In some embodiments, A or B are independently a nitrogen-containing heterocyclyl, e.g., heterocyclyl comprising one or more nitrogen atom. The one or more nitrogen atom of the nitrogen-containing heterocyclyl may be at any position of the ring. In some embodiments, the nitrogen-containing heterocyclyl is monocyclic, bicyclic, or tricyclic. In some embodiments, A or B are independently heterocyclyl comprising at least 1, at least 2, at least 3, at least 4, at least 5, or at least 6 nitrogen atoms. In some embodiments, A is heterocyclyl comprising 1 nitrogen atom. In some embodiments, B is heterocyclyl comprising 1 nitrogen atom. In some embodiments, A is heterocyclyl comprising 2 nitrogen atoms. In some embodiments, B is heterocyclyl comprising 2 nitrogen atoms. In some embodiments, A is heterocyclyl comprising 3 nitrogen atoms. In some embodiments, B is heterocyclyl comprising 3 nitrogen atoms. In some embodiments, A is heterocyclyl comprising 4 nitrogen atoms. In some embodiments, B is heterocyclyl comprising 4 nitrogen atoms. In some embodiments, A or B are independently a nitrogen-containing heterocyclyl comprising one or more additional heteroatoms, e.g., one or more of oxygen, sulfur, boron, silicon, or phosphorus. In some embodiments, the one or more nitrogen of the nitrogen-containing heterocyclyl is substituted, e.g., with $R^1$.

In some embodiments, A or B are independently a nitrogen-containing heteroaryl, e.g., heteroaryl comprising one or more nitrogen atom. The one or more nitrogen atom of the nitrogen-containing heteroaryl may be at any position of the ring. In some embodiments, the nitrogen-containing heteroaryl is monocyclic, bicyclic, or tricyclic. In some embodiments, A or B are independently heteroaryl comprising at least 1, at least 2, at least 3, at least 4, at least 5, or at least 6 nitrogen atoms. In some embodiments, A is heteroaryl comprising 1 nitrogen atom. In some embodiments, B is heteroaryl comprising 1 nitrogen atom. In some embodiments, A is heteroaryl comprising 2 nitrogen atoms. In some embodiments, B is heteroaryl comprising 2 nitrogen atoms. In some embodiments, A is heteroaryl comprising 3 nitrogen atoms. In some embodiments, B is heteroaryl comprising 3 nitrogen atoms. In some embodiments, A is heteroaryl comprising 4 nitrogen atoms. In some embodiments, B is heteroaryl comprising 4 nitrogen atoms. In some embodiments, A or B are independently a nitrogen-containing heteroaryl comprising one or more additional heteroatoms, e.g., one or more of oxygen, sulfur, boron, silicon, or phosphorus. In some embodiments, the one or more nitrogen of the nitrogen-containing heteroaryl is substituted, e.g., with $R^1$.

In some embodiments, A is a 6-membered nitrogen-containing heterocyclyl, e.g., a 6-membered heterocyclyl comprising one or more nitrogen. In some embodiments, A is a 6-membered heterocyclyl comprising 1 nitrogen atom. In some embodiments, A is a 6-membered heterocyclyl comprising 2 nitrogen atoms. In some embodiments, A is a 6-membered heterocyclyl comprising 3 nitrogen atoms. In some embodiments, A is a 6-membered heterocyclyl comprising 4 nitrogen atoms. The one or more nitrogen atom of the 6-membered nitrogen-containing heterocyclyl may be at any position of the ring. In some embodiments, A is a 6-membered nitrogen-containing heterocyclyl optionally substituted with one or more $R^1$. In some embodiments, the one or more nitrogen of the 6-membered nitrogen-containing heterocyclyl is substituted, e.g., with $R^1$. In some embodiments, A is a 6-membered nitrogen-containing heterocyclyl comprising one or more additional heteroatoms, e.g., one or more of oxygen, sulfur, boron, silicon, or phosphorus.

In some embodiments, B is a 5-membered nitrogen-containing heterocyclyl or heteroaryl, e.g., a 5-membered heterocyclyl or heteroaryl comprising one or more nitrogen. In some embodiments, B is a 5-membered heterocyclyl comprising 1 nitrogen atom. In some embodiments, B is a 5-membered heteroaryl comprising 1 nitrogen atom. In some embodiments, B is a 5-membered heterocyclyl comprising 2 nitrogen atoms. In some embodiments, B is a 5-membered heteroaryl comprising 2 nitrogen atoms. In some embodiments, B is a 5-membered heterocyclyl comprising 3 nitrogen atoms. In some embodiments, B is a 5-membered heteroaryl comprising 3 nitrogen atoms. The one or more nitrogen atom of the 5-membered nitrogen-containing heterocyclyl or heteroaryl may be at any position of the ring. In some embodiments, B is a 5-membered nitrogen-containing heterocyclyl optionally substituted with one or more $R^1$. In some embodiments, B is a 5-membered nitrogen-containing heteroaryl optionally substituted with one or more $R^1$. In some embodiments, the one or more nitrogen of the 5-membered nitrogen-containing heterocyclyl or heteroaryl is substituted, e.g., with $R^1$. In some embodiments, B is a 5-membered nitrogen-containing heterocyclyl or heteroaryl comprising one or more additional heteroatoms, e.g., one or more of oxygen, sulfur, boron, silicon, or phosphorus.

In some embodiments, B is a nitrogen-containing bicyclic heteroaryl (e.g., a 9-membered nitrogen-containing bicyclic heteroaryl), that is optionally substituted with one or more $R^1$. In some embodiments, B is a 9-membered bicyclic heteroaryl comprising 1 nitrogen atom. In some embodiments, B is a 9-membered bicyclic heteroaryl comprising 2 nitrogen atoms. In some embodiments, B is a 9-membered bicyclic heteroaryl comprising 3 nitrogen atoms. In some embodiments, B is a 9-membered bicyclic heteroaryl comprising 4 nitrogen atoms. The one or more nitrogen atom of the 9-membered bicyclic heteroaryl may be at any position of the ring. In some embodiments, B is a 9-membered bicyclic heteroaryl substituted with one or more $R^1$.

In some embodiments, each of A and B are independently selected from:

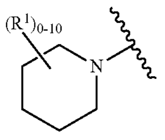
,
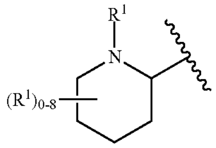
,
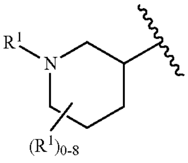
,
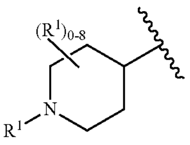
,
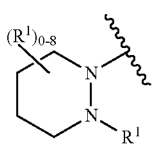
,
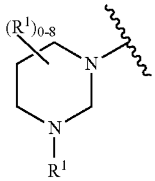
,

-continued
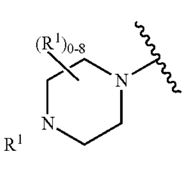, 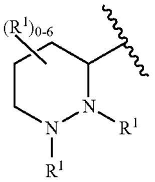,
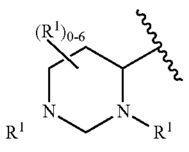, 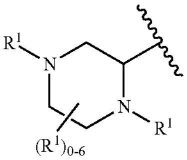,
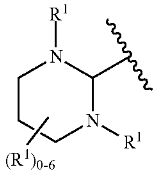, 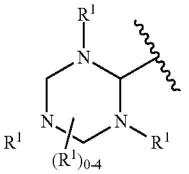,
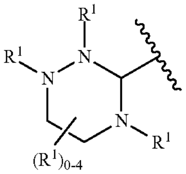, 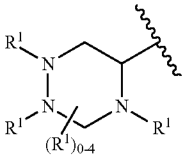,
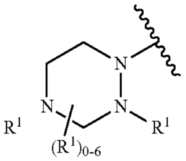, 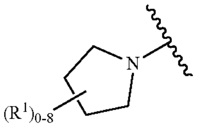,
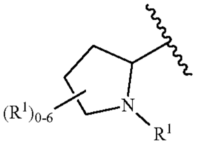, 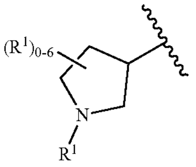,
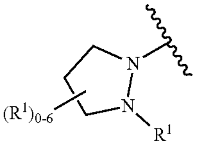, 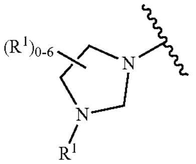,
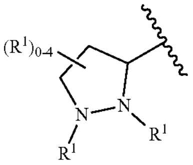, 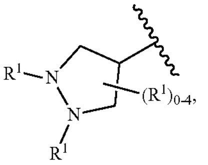
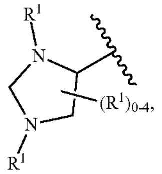 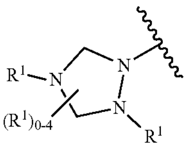,
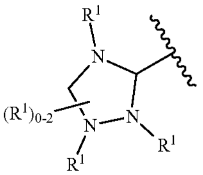, 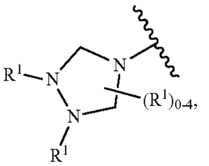
-continued
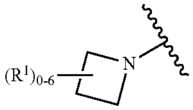, 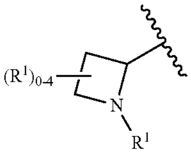,
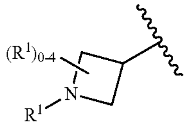, 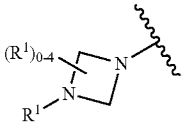,
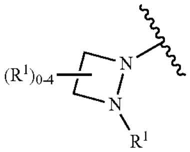, 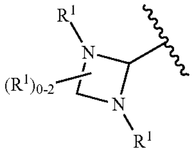,
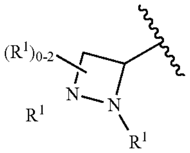, 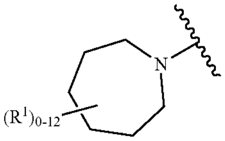,
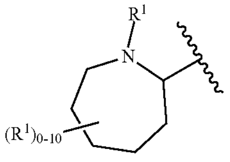, 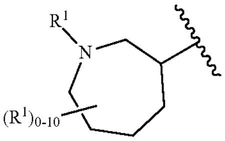,
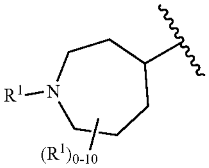, 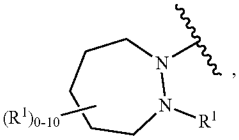,
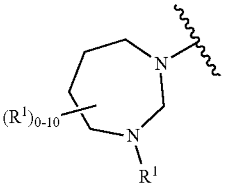, 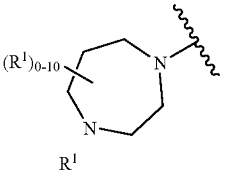,
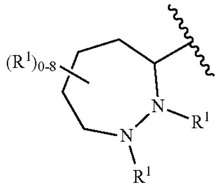, 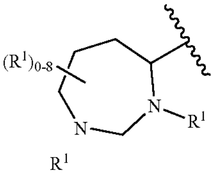,
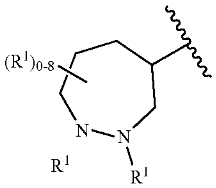, 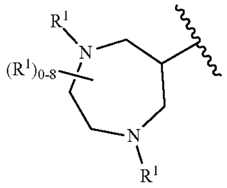
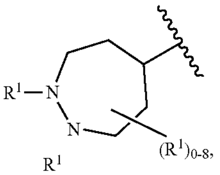 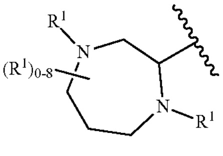, -continued
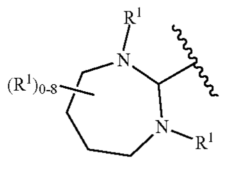,
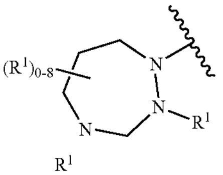,
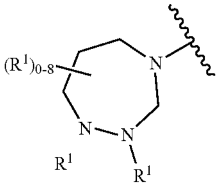,
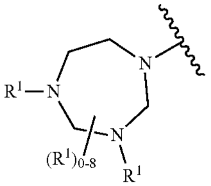,
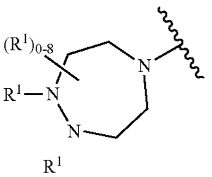,
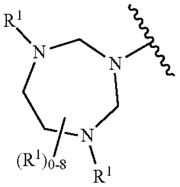,
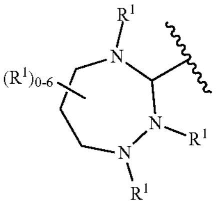,
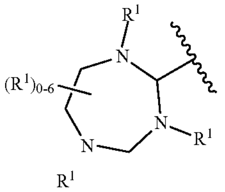,
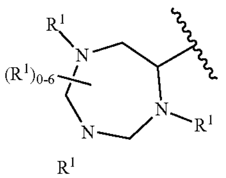,
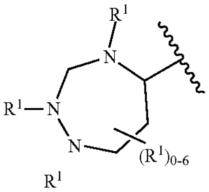,
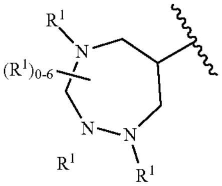,
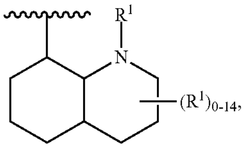
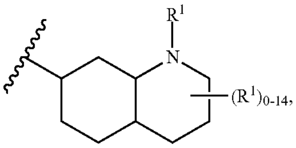
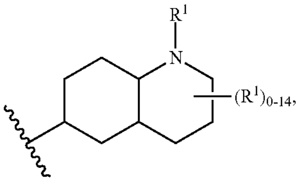
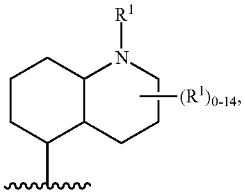
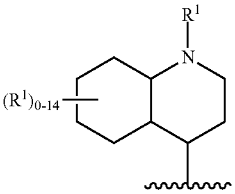,
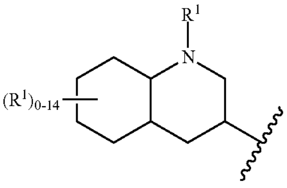,
-continued
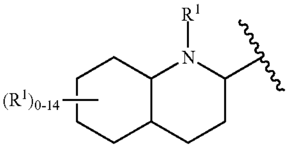,
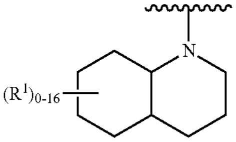,
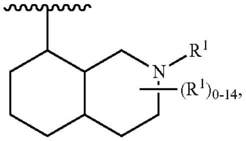
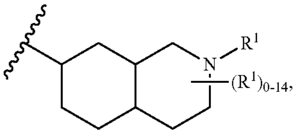
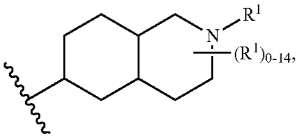
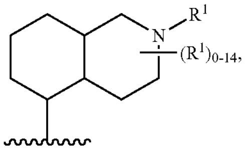
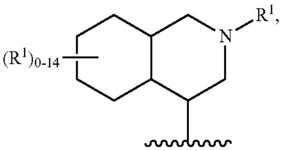
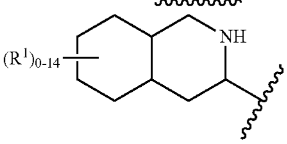,
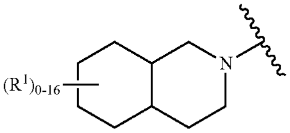,
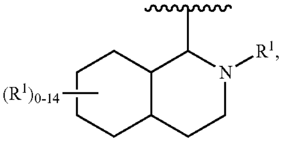
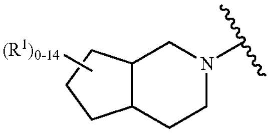,
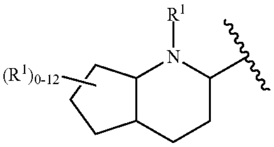,
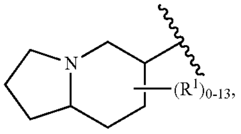
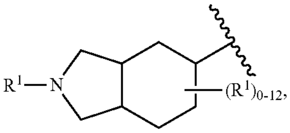
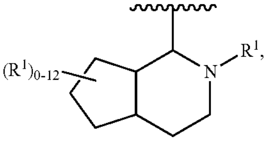
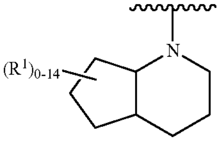,
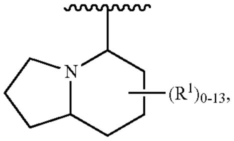
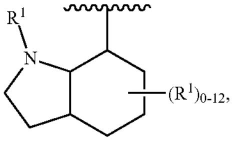

-continued
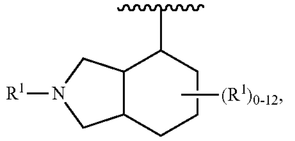
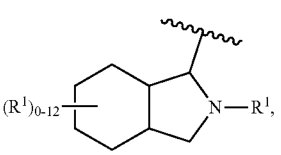
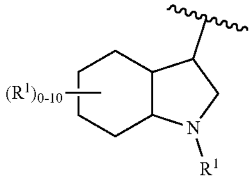
,
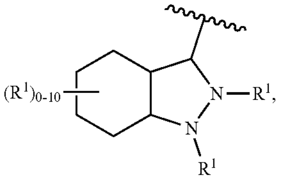
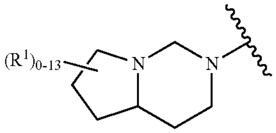
,
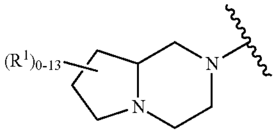
,
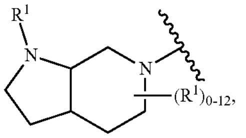
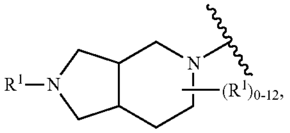
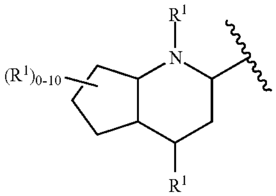
,
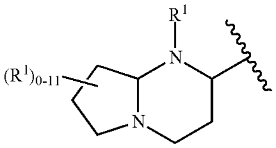
,
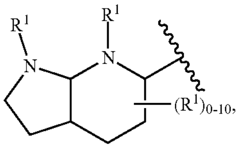
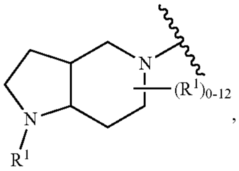
,
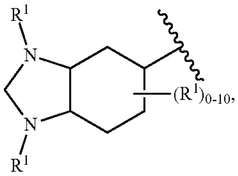
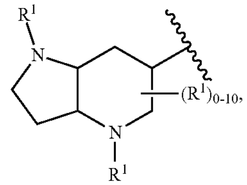
-continued
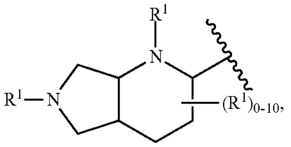
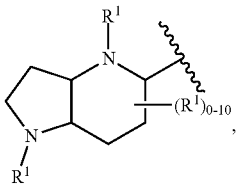
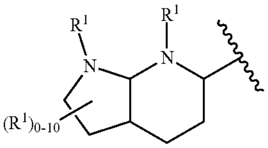
,
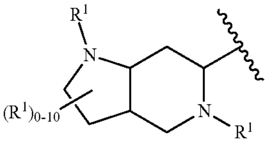
,
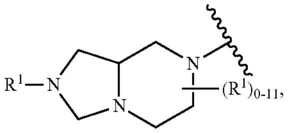
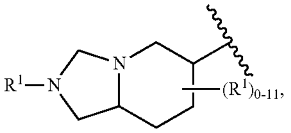
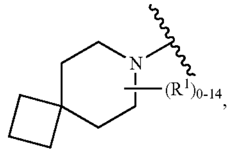
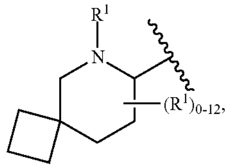
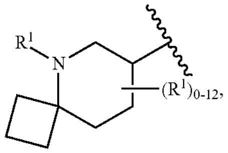
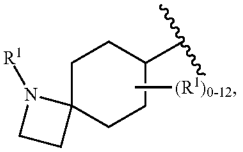
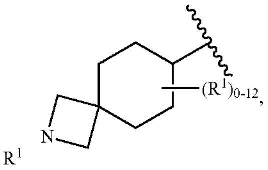
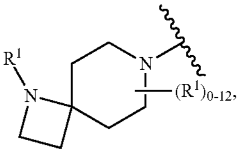
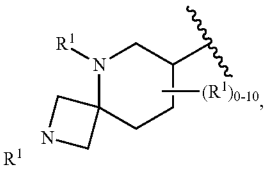
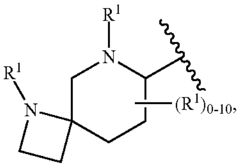
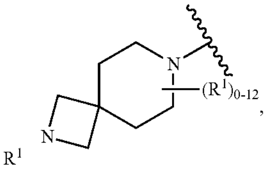
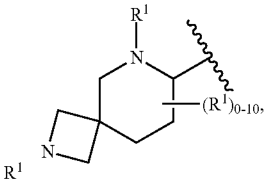
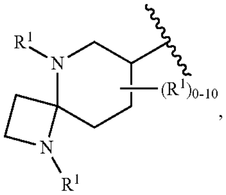

-continued
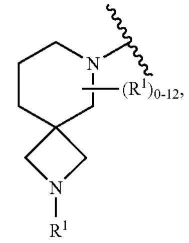
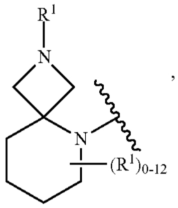
,
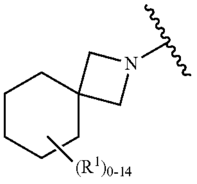
,
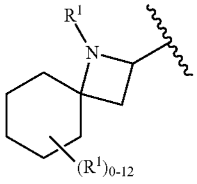
,
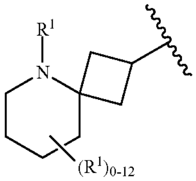
,
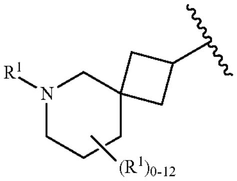
,
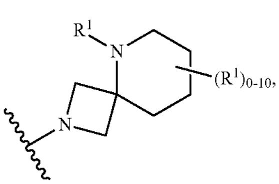
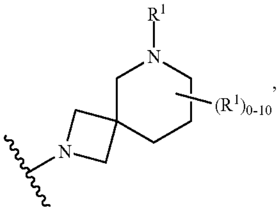
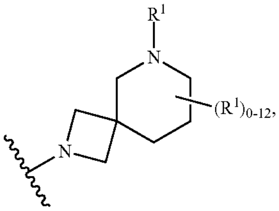
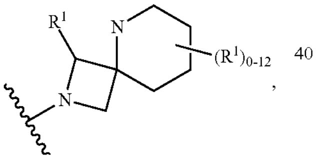
,
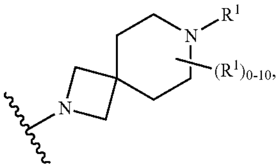
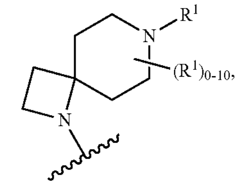
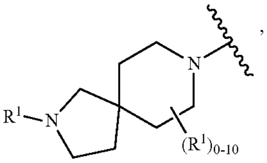
,
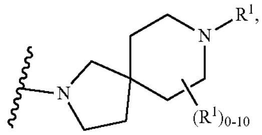
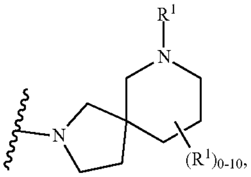
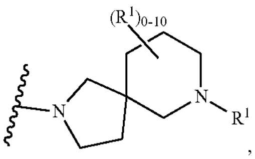
,
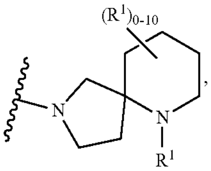
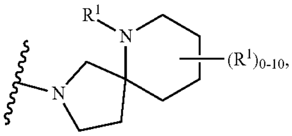
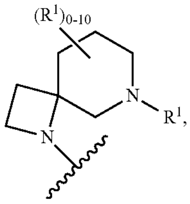
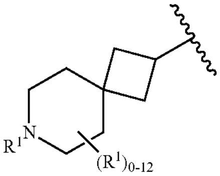
,
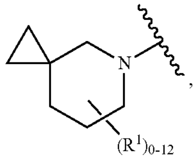
,
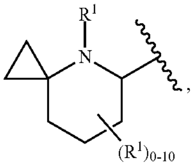
,
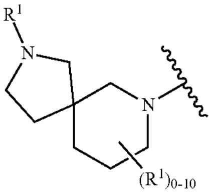
,
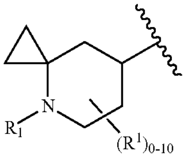
,
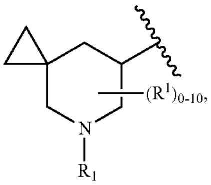
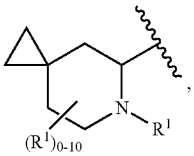
,
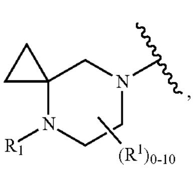
,
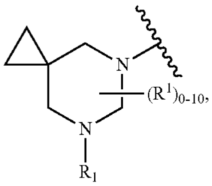
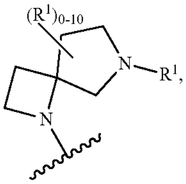
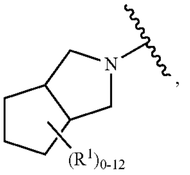
,
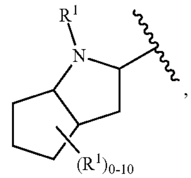
,
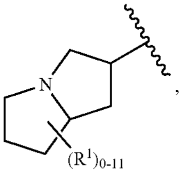
,
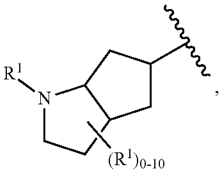
,
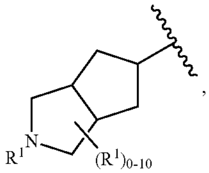
, -continued
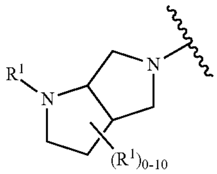,
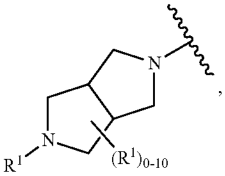,
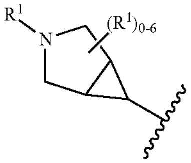,
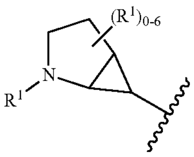,
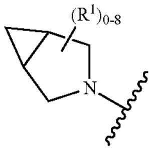,
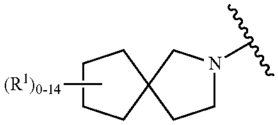,
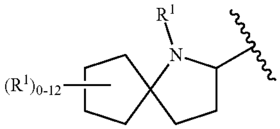,
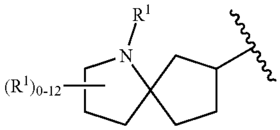,
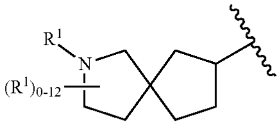,
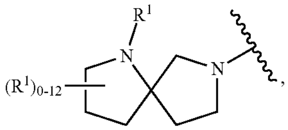,
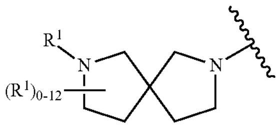,
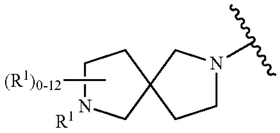,
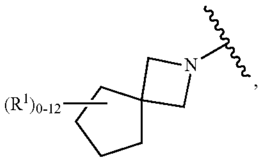,
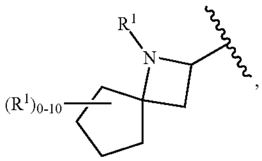,
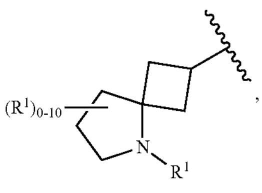,
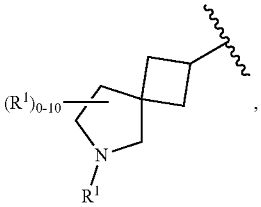,
-continued
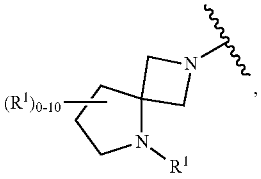,
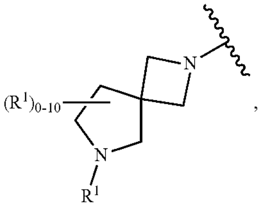,
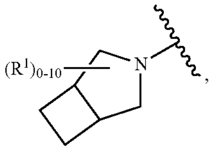,
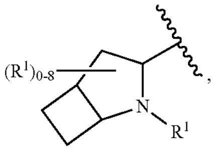,
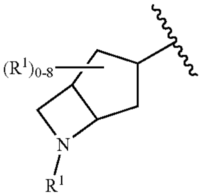,
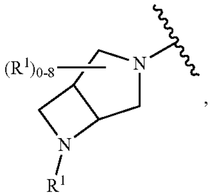,
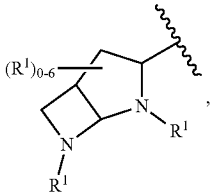,
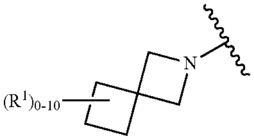,
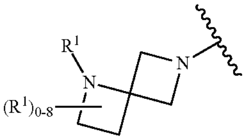,
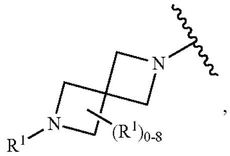,
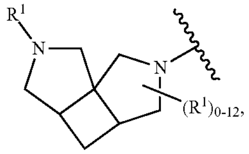
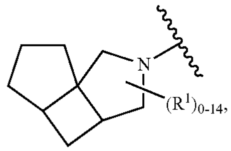
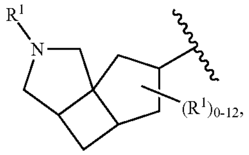
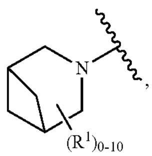,
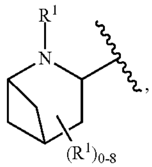,
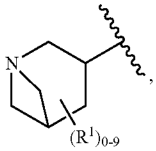,
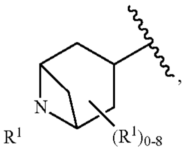,
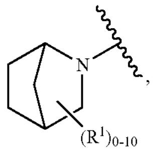,
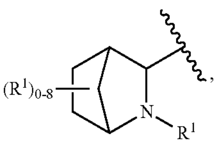,
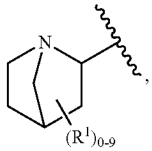, -continued
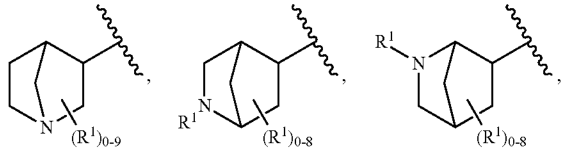
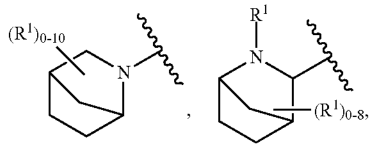
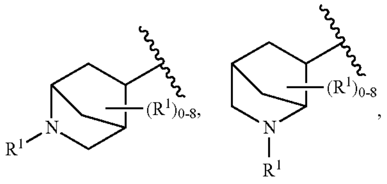
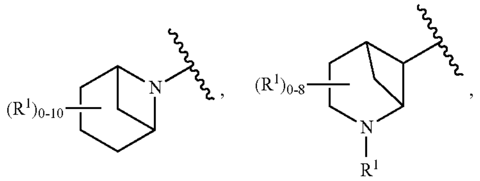
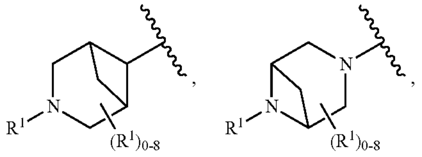
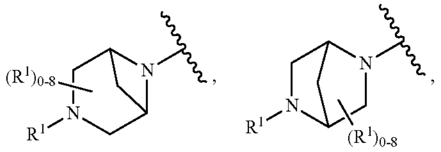
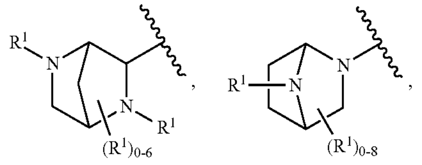
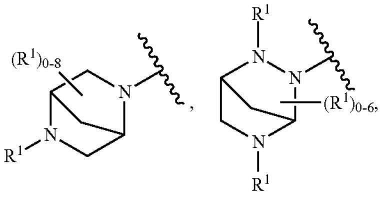
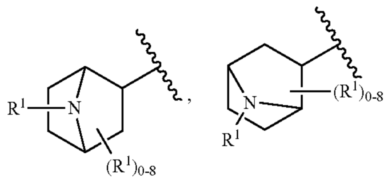
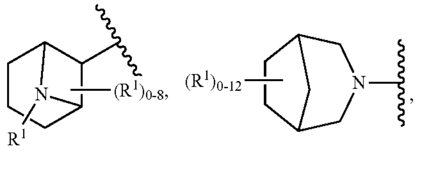
-continued
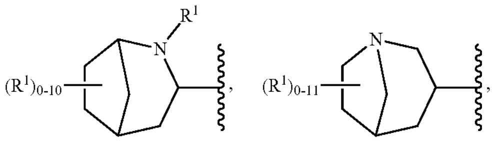
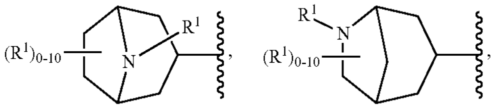
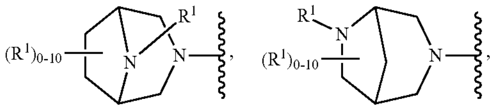
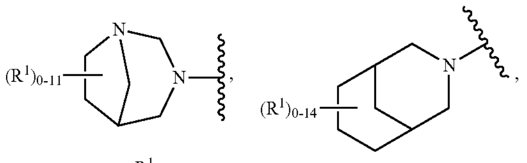
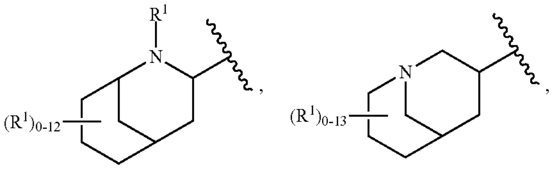
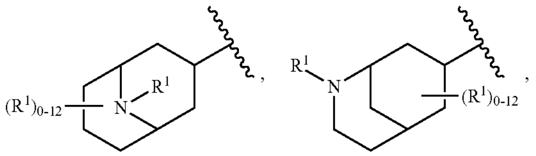
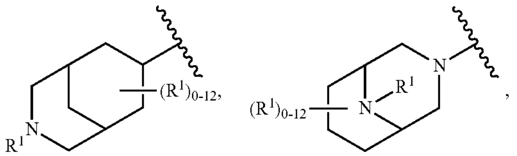
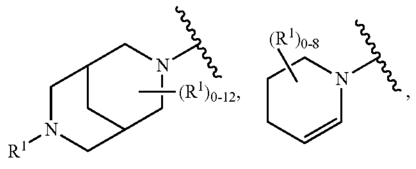
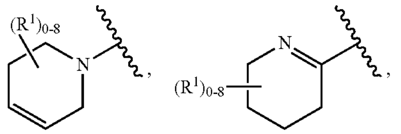
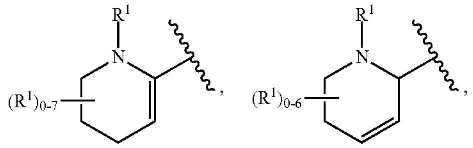
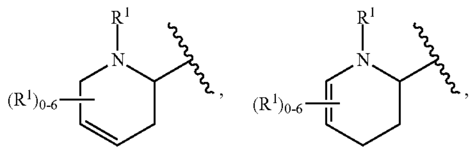
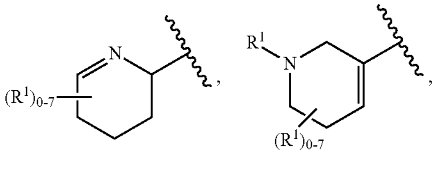

-continued
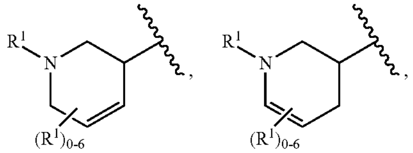
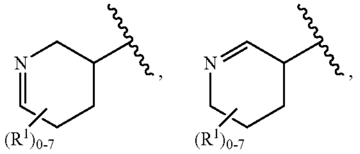
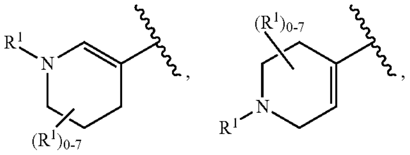
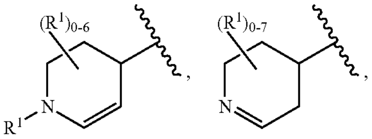
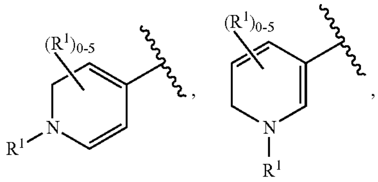
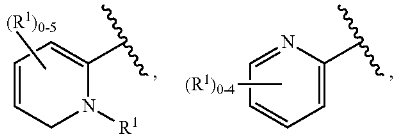
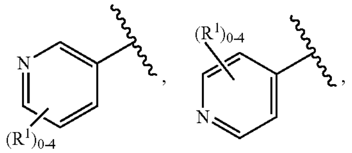
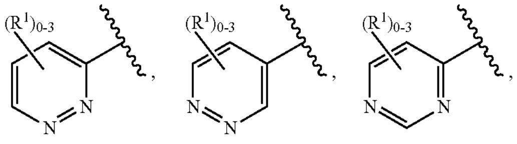
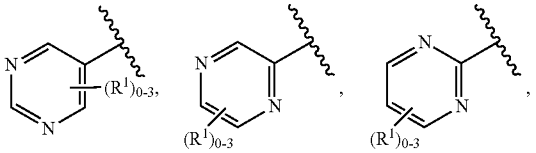
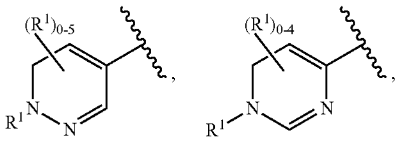
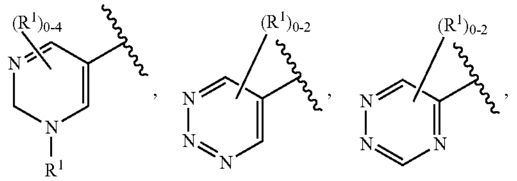
-continued
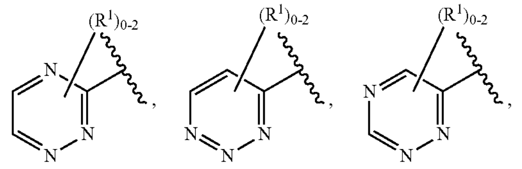
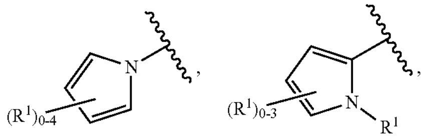
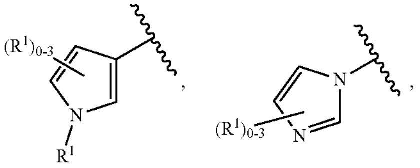
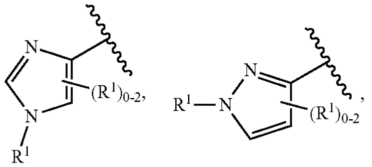
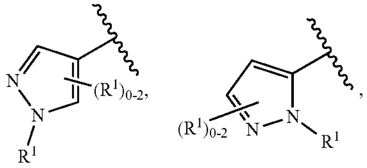
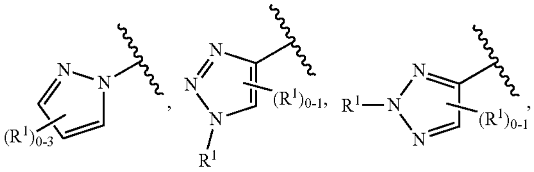
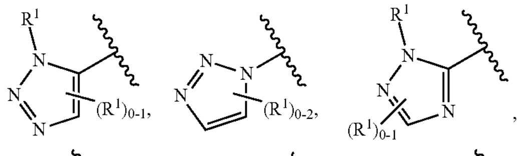
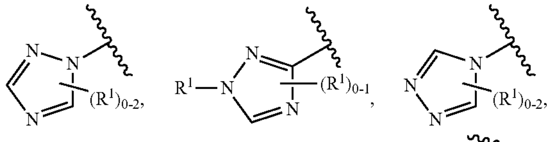
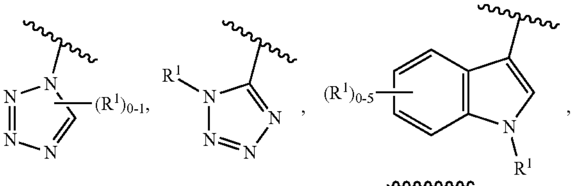
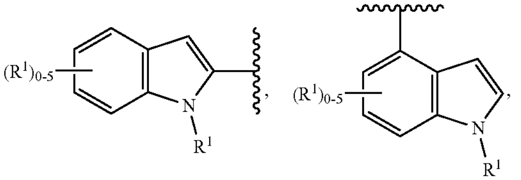

-continued
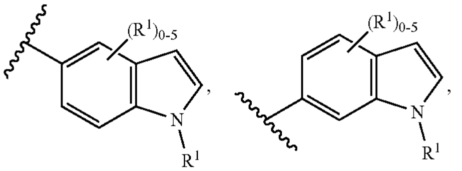
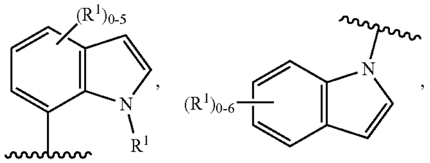
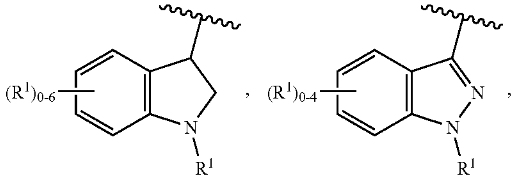
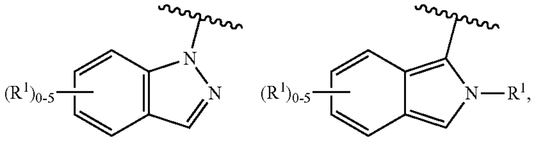
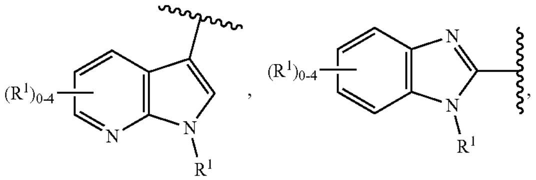
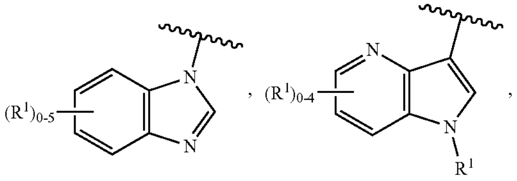
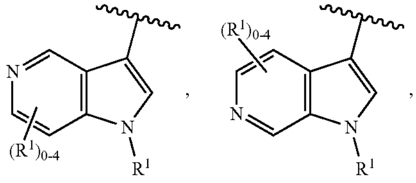
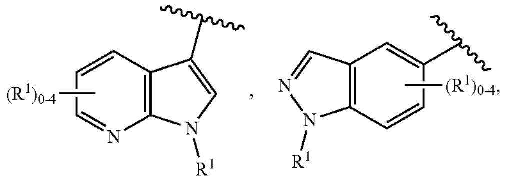
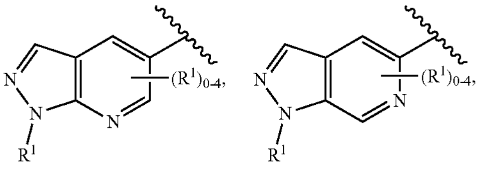
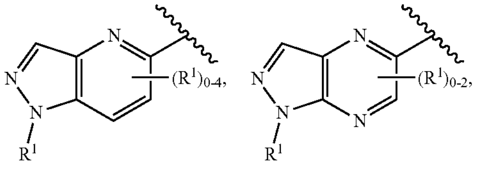
-continued
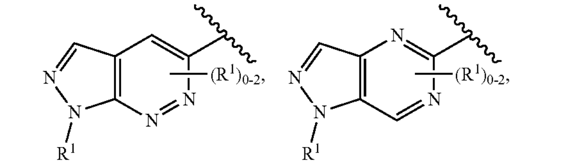
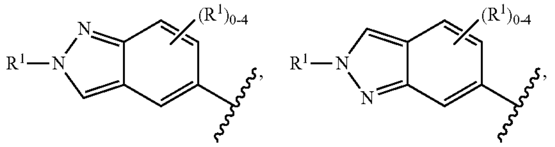
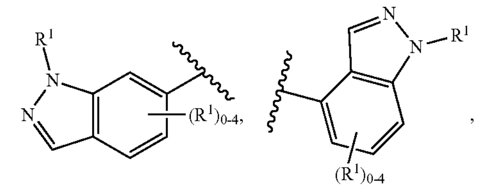
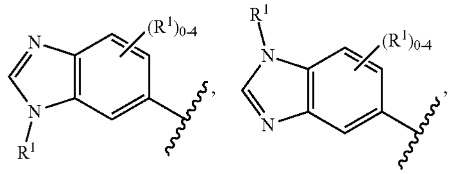
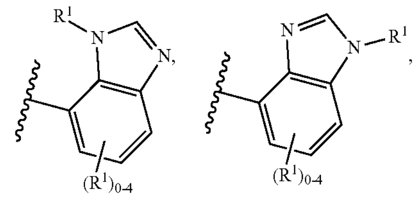
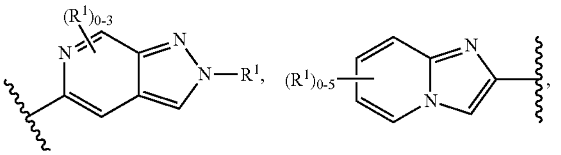
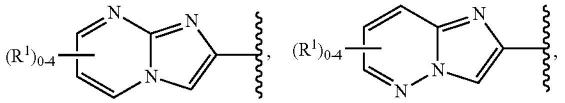
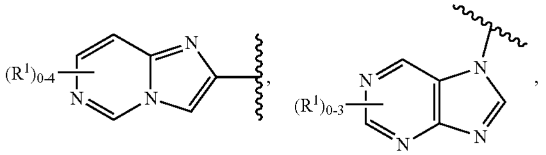
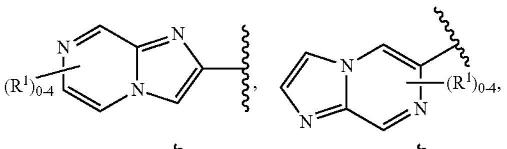
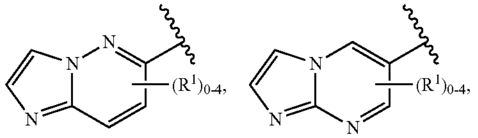
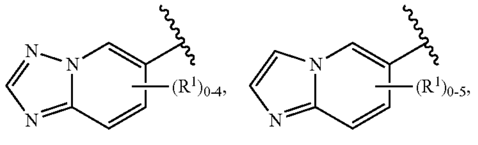

-continued

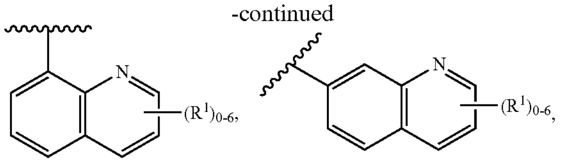

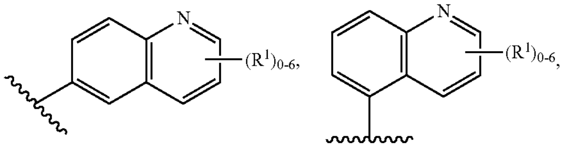

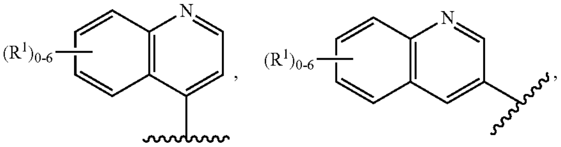

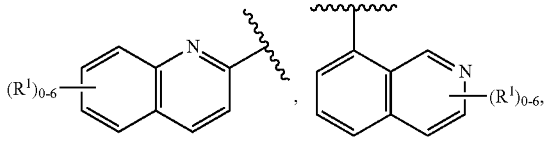

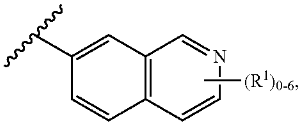

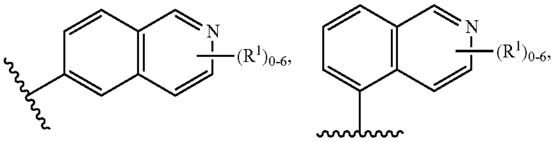

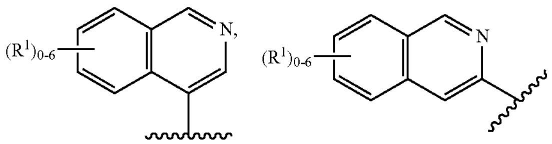

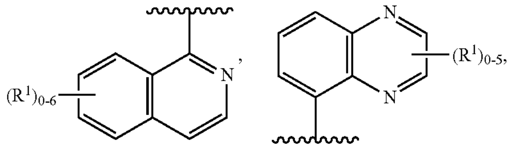

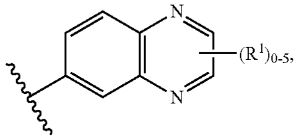

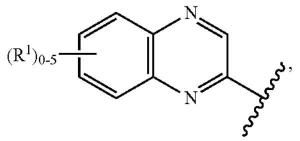

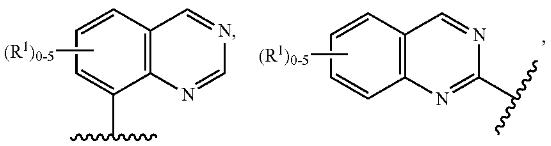

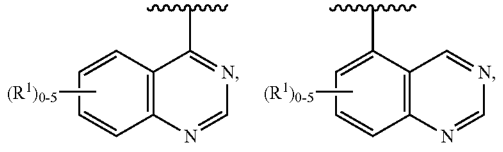

-continued

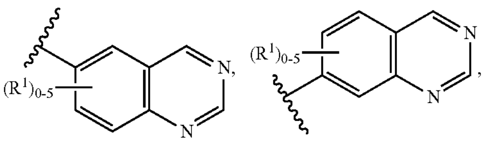

and

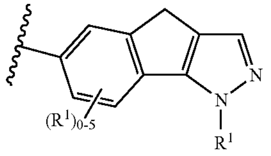

wherein each $R^1$ is as defined herein. In an embodiment, A and B are each independently a saturated, partially saturated, or unsaturated (e.g., aromatic) derivative of one of the rings described above. In an embodiment, A and B are each independently a stereoisomer of one of the rings described above.

In some embodiments, each of A and B are independently selected from:

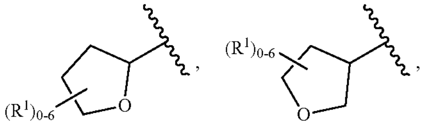

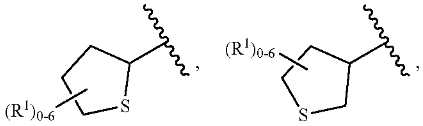

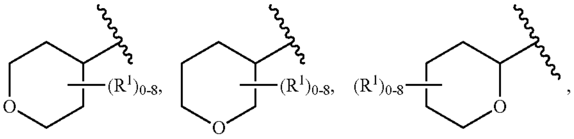

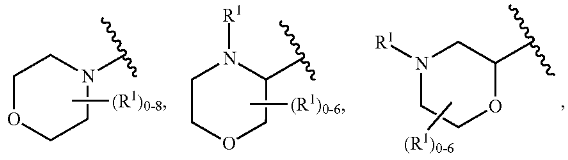

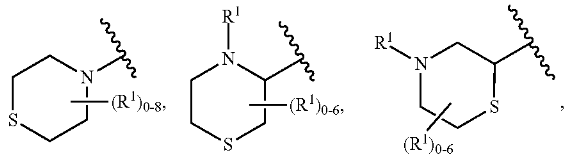

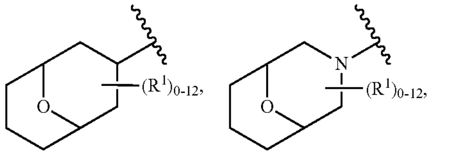

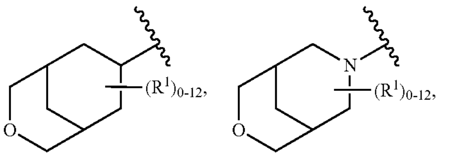

-continued
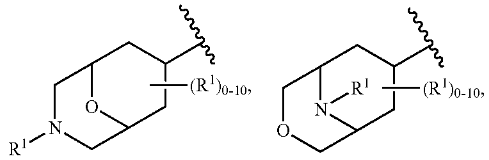
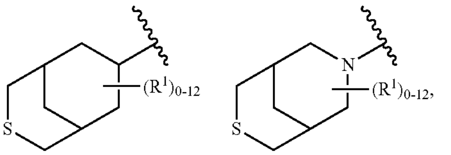
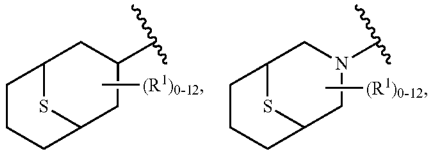
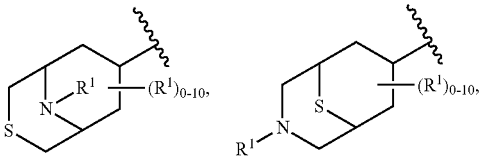
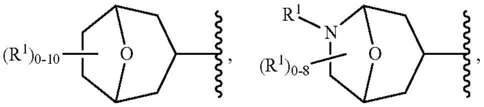
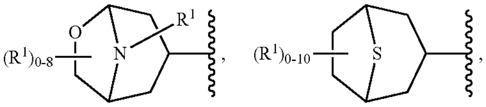
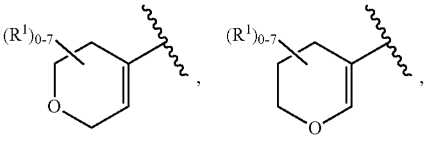
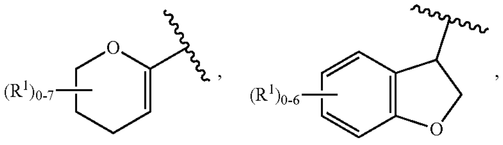
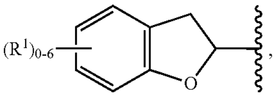
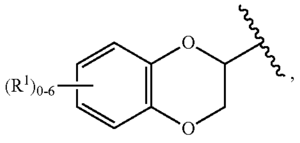
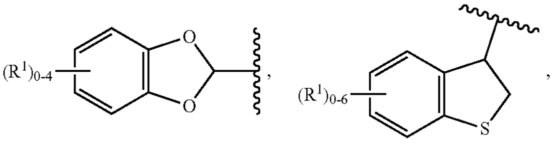
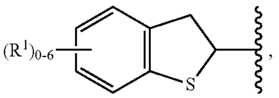
-continued
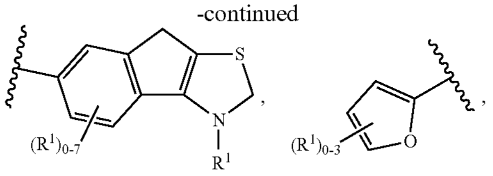
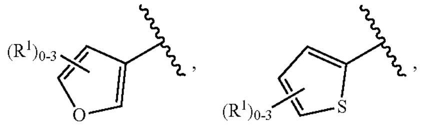
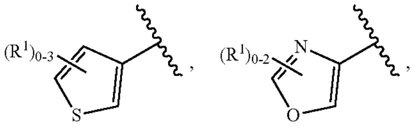
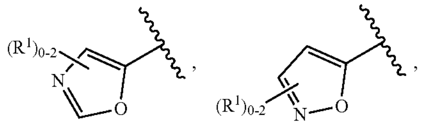
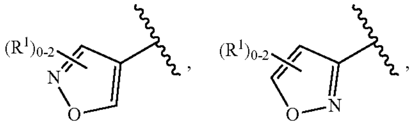
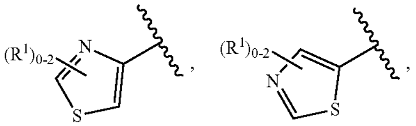
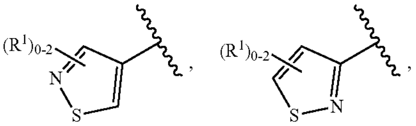
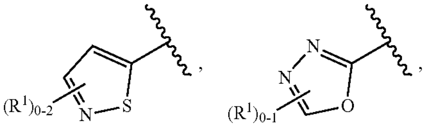
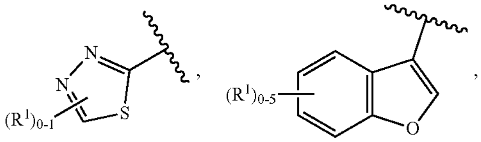
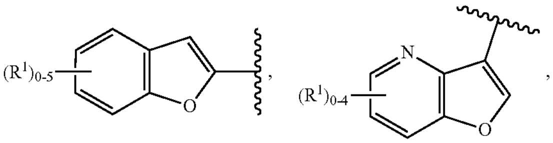
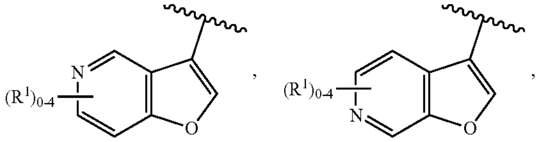
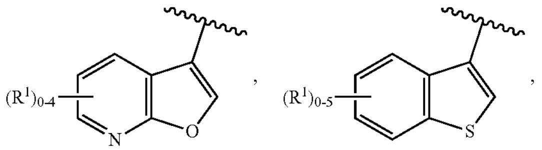
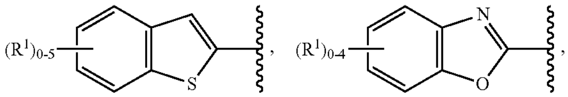

-continued

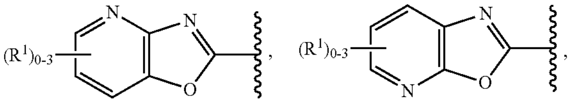

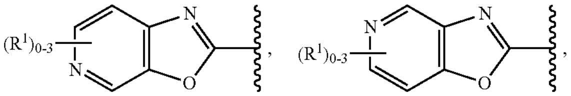

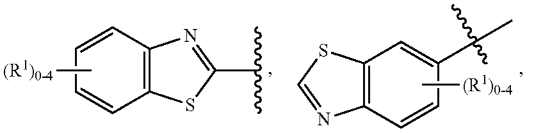

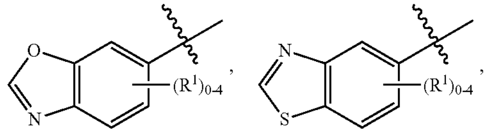

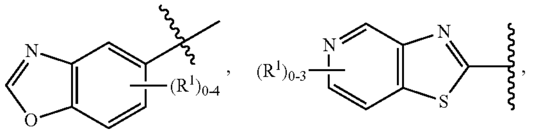

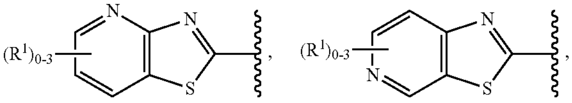

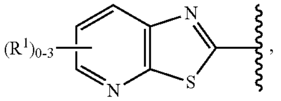

and

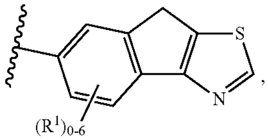

wherein each $R^1$ is as defined herein. In an embodiment, A and B are each independently a saturated, partially saturated, or unsaturated (e.g., aromatic) derivative of one of the rings described above. In an embodiment, A and B are each independently a stereoisomer of one of the rings described above.

In some embodiments, A is selected from

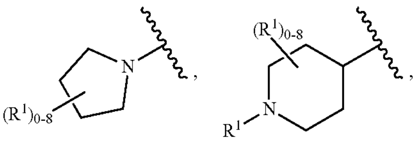

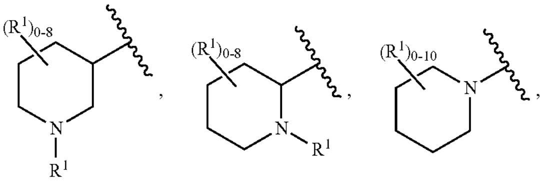

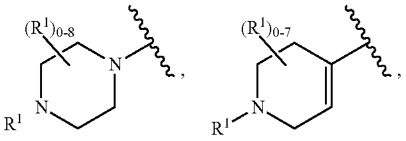

-continued

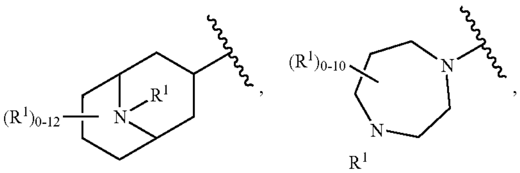

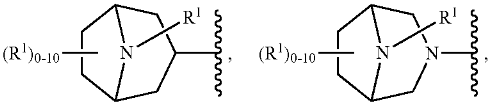

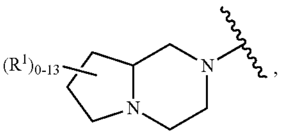

and

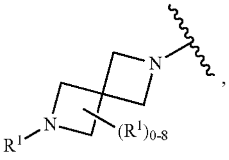

wherein $R^1$ is as defined herein.

In some embodiments, A is selected from

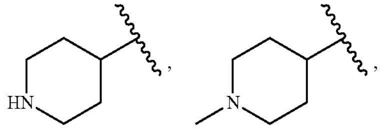

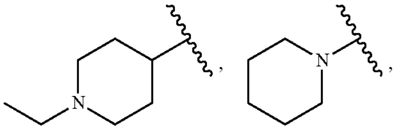

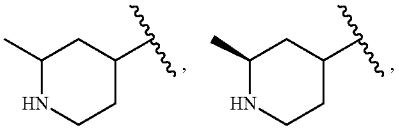

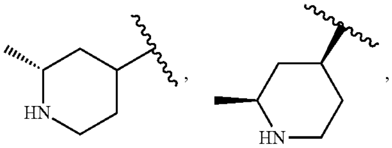

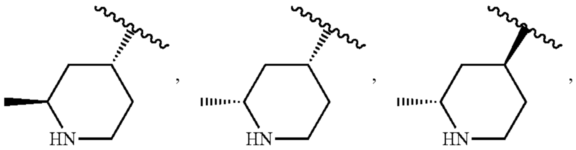

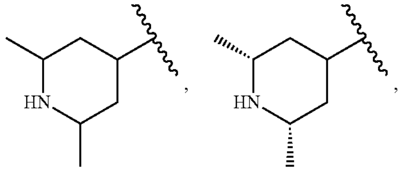

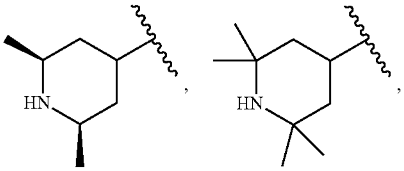

-continued
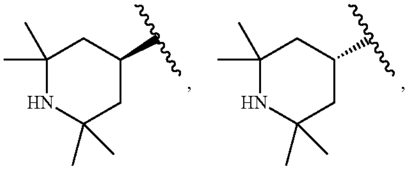
, ,
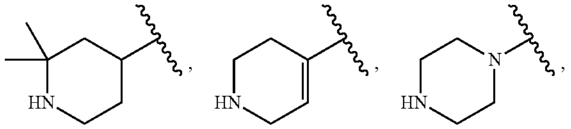
, , ,
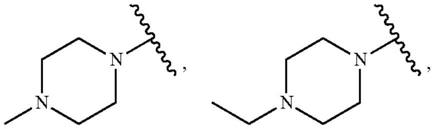
, ,
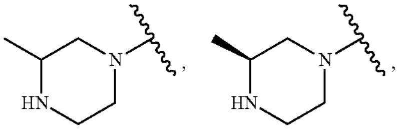
, ,
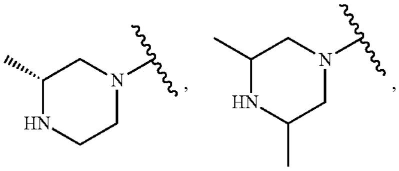
, ,
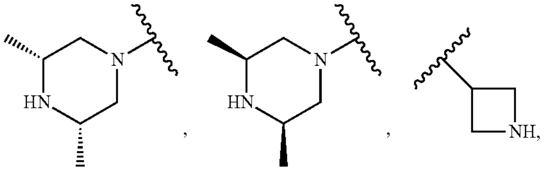
, ,
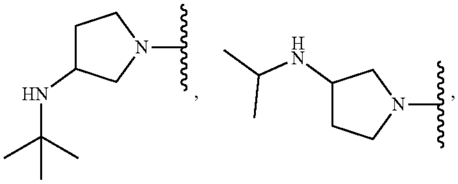
, ,
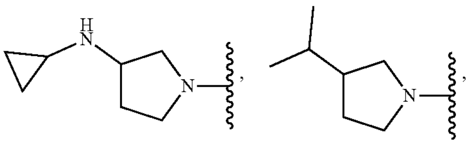
, ,
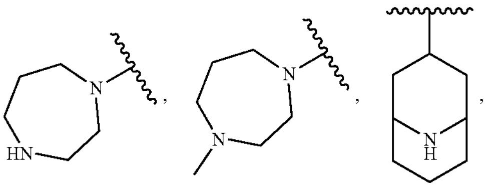
, , ,
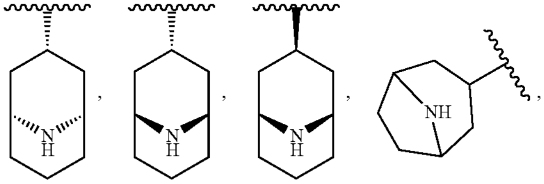
, , , ,
-continued
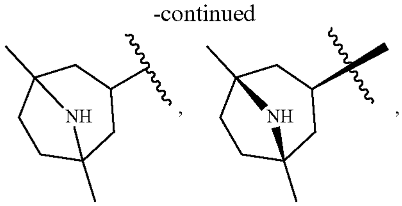
, ,
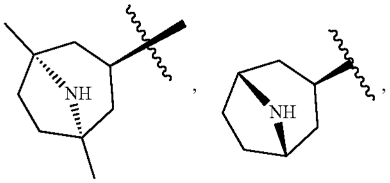
, ,
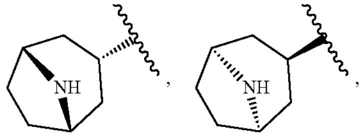
, ,
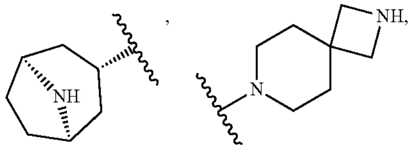
, ,
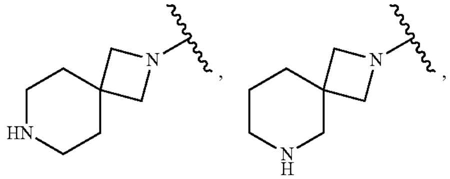
, ,
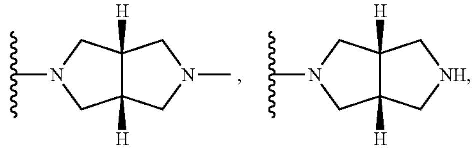
, ,
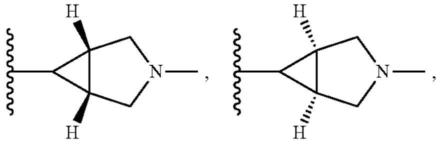
, ,
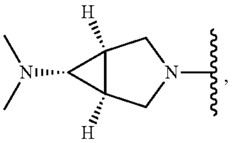
,
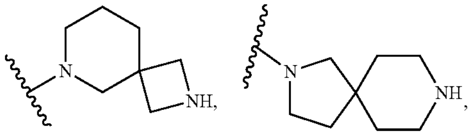
, ,
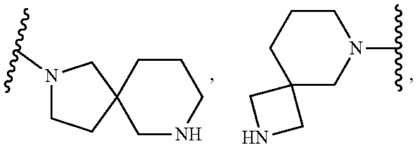
, ,
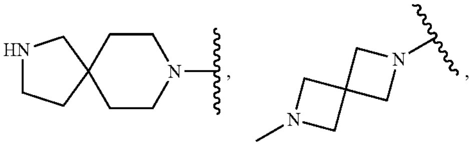
, , -continued
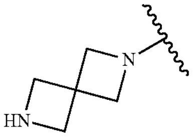, and 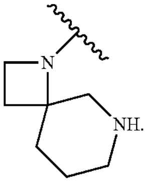
In some embodiments, A is selected from
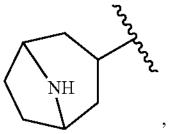, 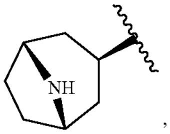, 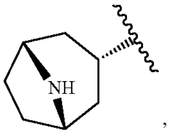, 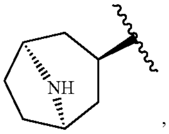, 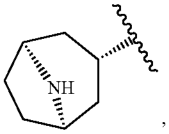, 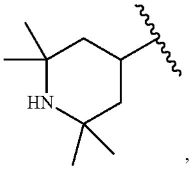, 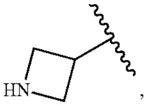, 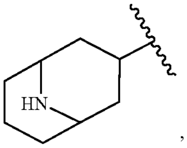, 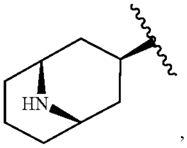, 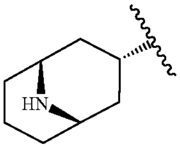, 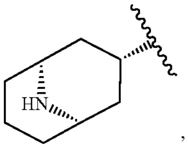, 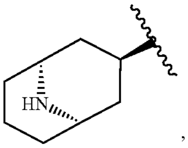, 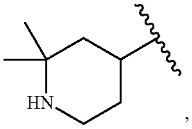, 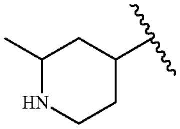, 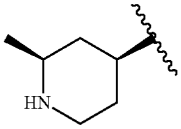, 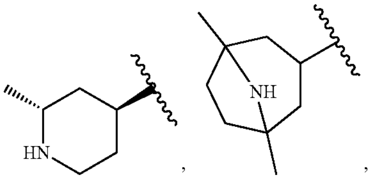, 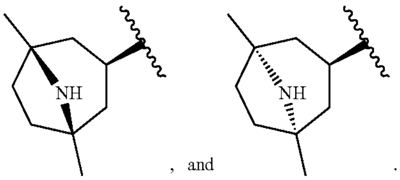.
In some embodiments, A is selected from
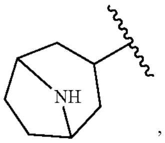, 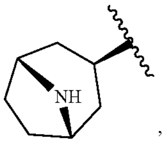, 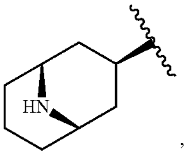,
-continued
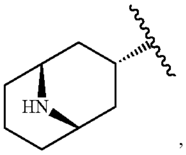, 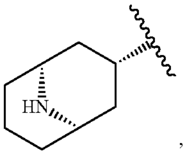, 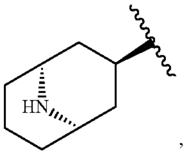, and 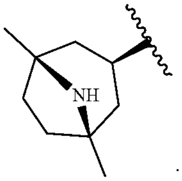.
In some embodiments, A is selected from wherein A is selected from
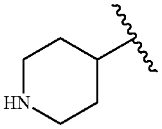, 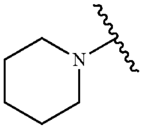, 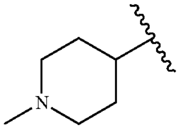, 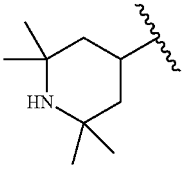, 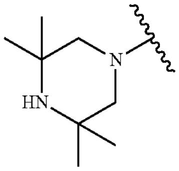, 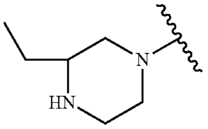, 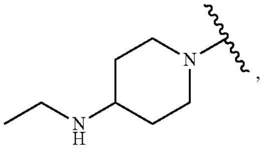, 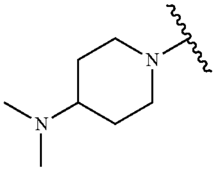, 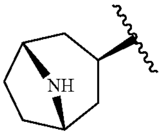, 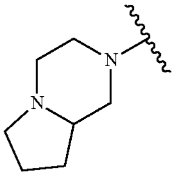, 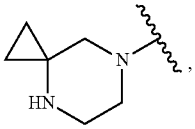, 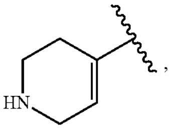, 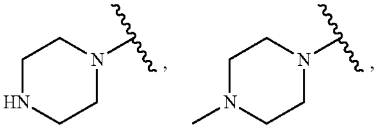, 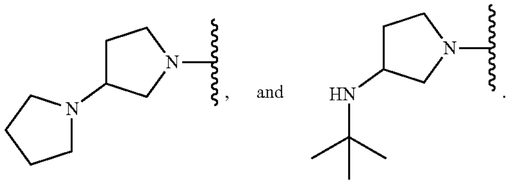.

In some embodiments, A is
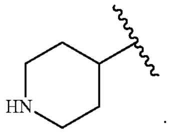
In some embodiments, A is
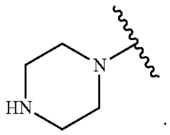
In some embodiments, A is
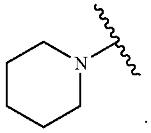 [SMILES: *N1CCCCC1]
In some embodiments, A is
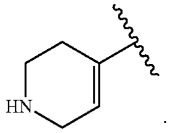
In some embodiments, A is
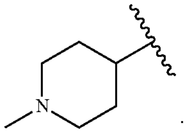
In some embodiments, A is
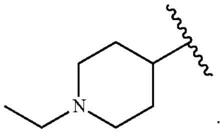 [SMILES: *C1CCN(CC)CC1]
In some embodiments, A is
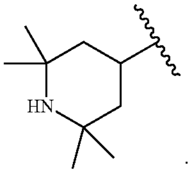 [SMILES: *C1CC(C)(C)NC(C)(C)C1]
In some embodiments, A is
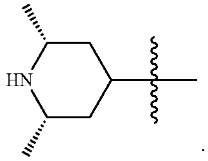
In some embodiments, A is
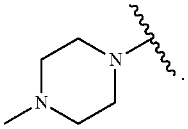 [SMILES: *N1CCN(C)CC1]
In some embodiments, A is
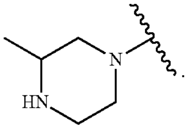 [SMILES: *N1CCNC(C)C1]
In some embodiments, A is
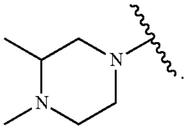 [SMILES: *N1CCN(C)C(C)C1]
In some embodiments, A is
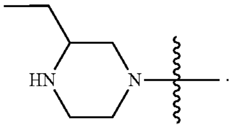 [SMILES: *N1CCNC(CC)C1]
In some embodiments, A is
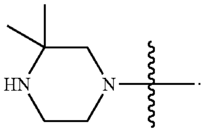

In some embodiments, A is
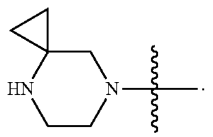 [SMILES: *N1CCNC2(CC2)C1]
In some embodiments, A is
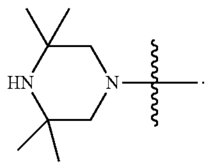 [SMILES: *N1CC(C)(C)NC(C)(C)C1]
In some embodiments, A is
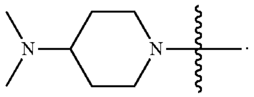 [SMILES: *N1CCC(N(C)C)CC1]
In some embodiments, A is
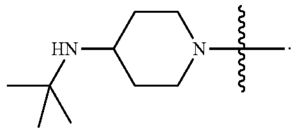 [SMILES: *N1CCC(NC(C)(C)C)CC1]
In some embodiments, A is
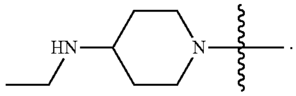 [SMILES: *N1CCC(NCC)CC1]
In some embodiments, A is
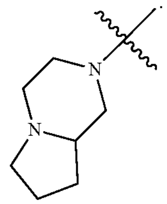 [SMILES: *N1CCN2CCCC2C1]
In some embodiments, A is
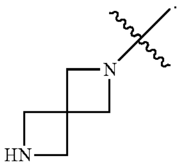
In some embodiments, A is
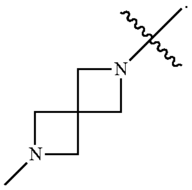 [SMILES: *N1CC2(C1)CN(C)C2]
In some embodiments, A is
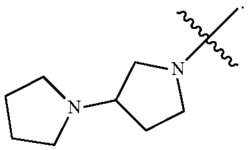 [SMILES: *N1CCC(N2CCCC2)C1]
In some embodiments, A is
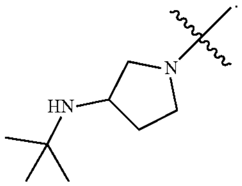 [SMILES: *N1CCC(NC(C)(C)C)C1]
In some embodiments, A is
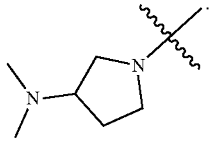 [SMILES: *N1CCC(N(C)C)C1]
In some embodiments, A is
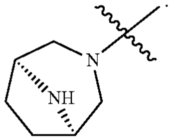 [SMILES: *N1C[C@H]2CC[C@@H](C1)N2]

In some embodiments, A is
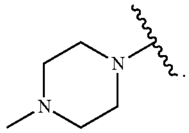 [SMILES: *N1CCN(C)CC1]
In some embodiments, A is
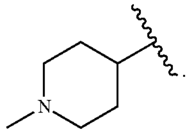 [SMILES: *C1CCN(C)CC1]
In some embodiments, A is
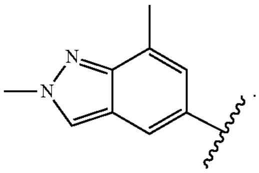 [SMILES: *c1cc(C)c2nn(C)cc2c1]
In some embodiments, A is
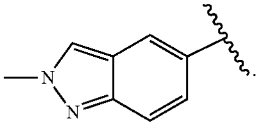 [SMILES: *c1ccc2nn(C)cc2c1]
In some embodiments, B is selected from
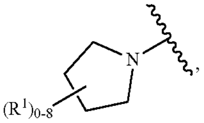 , 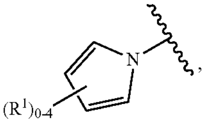 , 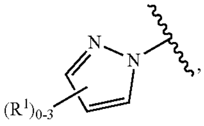 , and 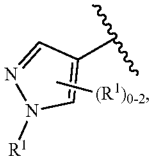 ,
wherein $R^1$ is as defined herein. In some embodiments, B is selected from
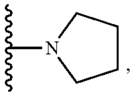 , 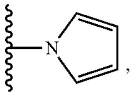 ,
-continued
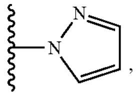 , and 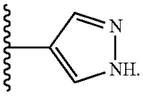
In some embodiments, B is selected from
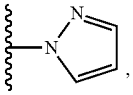 , 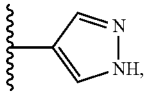 , 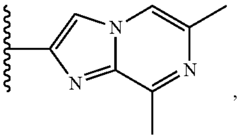 ,
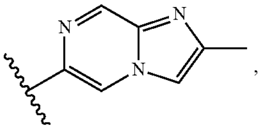 , 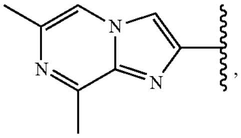 ,
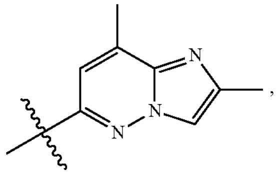 , 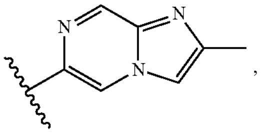 ,
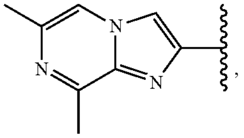 , 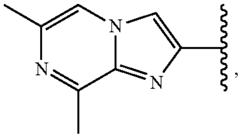 ,
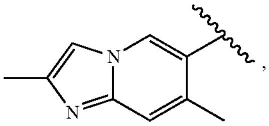 , 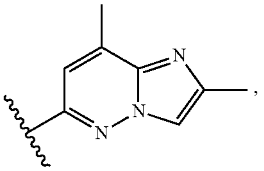 ,
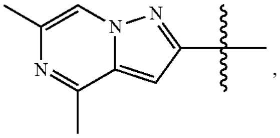 , 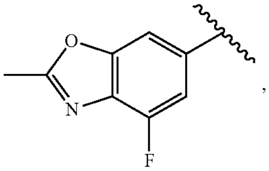 ,
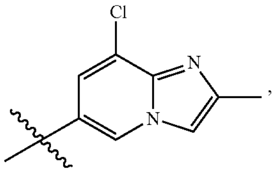 , 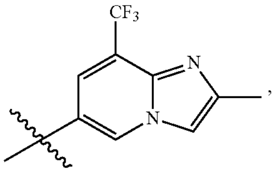 ,
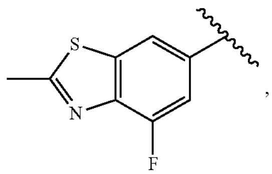 , 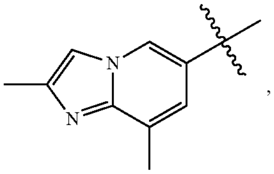 ,
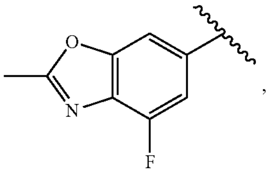 , 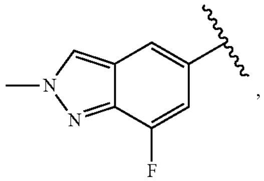 , -continued
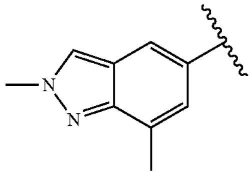
, and
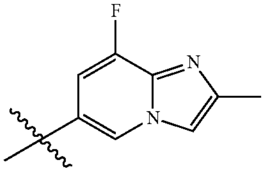
.
In some embodiments, B is selected from
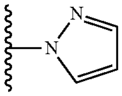
,
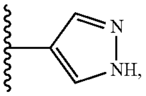
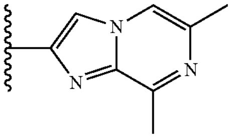
,
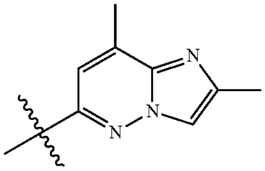
,
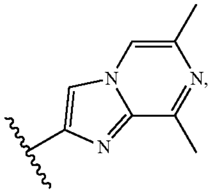
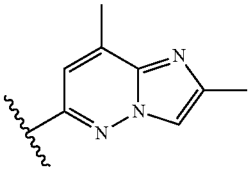
,
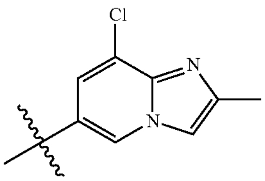
,
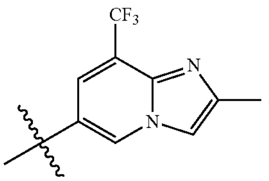
, and
-continued
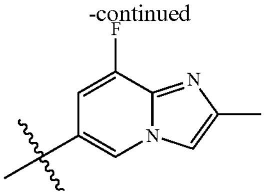
.
In some embodiments, B is
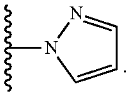
.
In some embodiments, B is
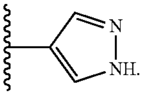 [SMILES: *c1cn[nH]c1]
In some embodiments, B is
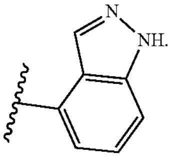 [SMILES: *c1cccc2[nH]ncc12]
In some embodiments, B is
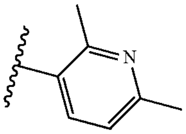
.
In some embodiments, B is
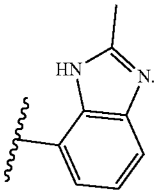 [SMILES: *c1cccc2nc(C)[nH]c12]
In some embodiments, B is
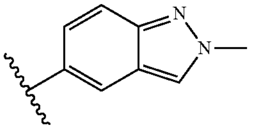
.

In some embodiments, B is
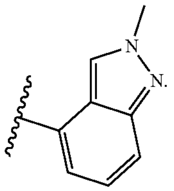 [SMILES: *c1cccc2nn(C)cc12]
In some embodiments, B is
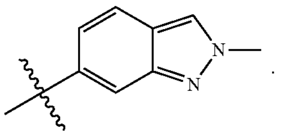 [SMILES: *c1ccc2cn(C)nc2c1]
In some embodiments, B is
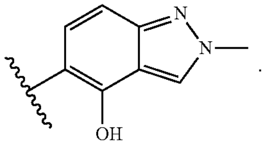 [SMILES: *c1ccc2nn(C)cc2c1O]
In some embodiments, B is
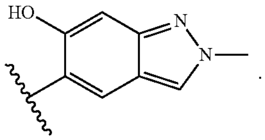 [SMILES: *c1cc2cn(C)nc2cc1O]
In some embodiments, B is
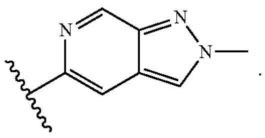 [SMILES: *c1cc2cn(C)nc2cn1]
In some embodiments, B is
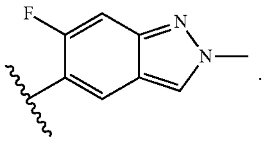 [SMILES: *c1cc2cn(C)nc2cc1F]
In some embodiments, B is
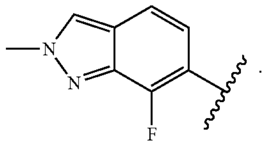 [SMILES: *c1ccc2cn(C)nc2c1F]
In some embodiments, B is
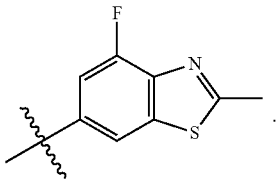 [SMILES: *c1cc(F)c2nc(C)sc2c1]
In some embodiments, B is
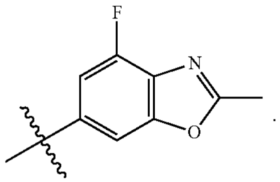 [SMILES: *c1cc(F)c2nc(C)oc2c1]
In some embodiments, B is selected is
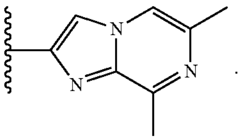
In some embodiments, B is
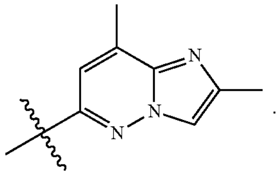 [SMILES: *c1cc(C)c2nc(C)cn2n1]
In some embodiments, B is
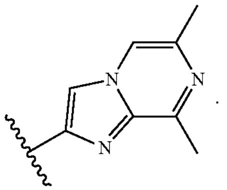 [SMILES: *c1cn2cc(C)nc(C)c2n1]

In some embodiments, B is

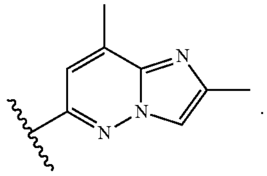 [SMILES: *c1cc(C)c2nc(C)cn2n1]

.

In some embodiments, B is

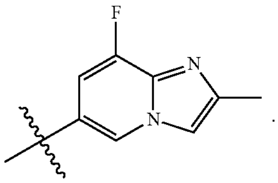 [SMILES: *c1cc(F)c2nc(C)cn2c1]

.

In some embodiments, B is a structure of Formula (A) or Formula (B):

(A)

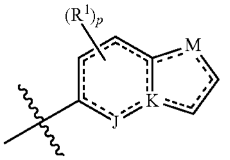

or (B)

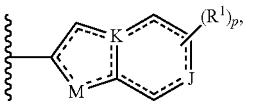

wherein each of J, K, and M is selected from N and C(R'); $R^1$ is as defined above; R' is hydrogen, halo (e.g., fluoro), or $C_1$-$C_6$-alkyl (e.g., methyl); and p is 0, 1, 2, 3, or 4; wherein at least one of J, K, and M is N; and the bonds in the ring comprising J, K, and M may be single or double bonds as valency permits.

In some embodiments, J, K, and M are each independently N. In some embodiments, J is C(R') and K and M are each independently M. In some embodiments, p is 0. In some embodiments, p is 1. In some embodiments, p is 2. In some embodiments, p is 3. In some embodiments, p is 4.

In some embodiments, B is selected from

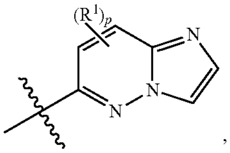

,

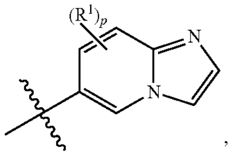

,

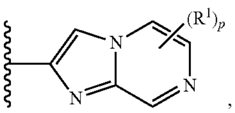

,

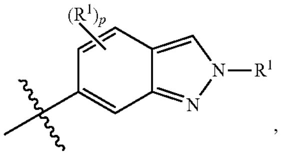

,

-continued

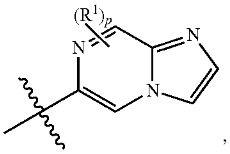

,

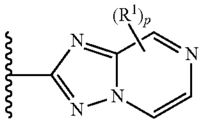

,

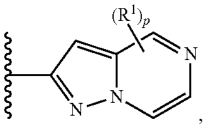

,

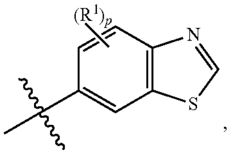

, and

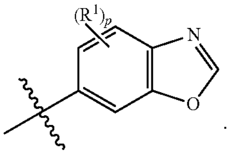

.

In some embodiments, B is

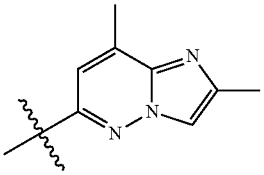

.

In some embodiments, B is

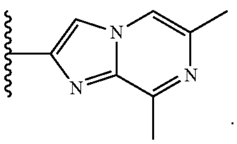 [SMILES: *c1cn2cc(C)nc(C)c2n1]

.

In some embodiments, B is

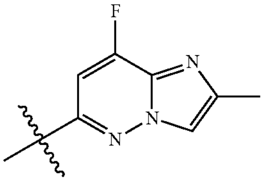

.

In some embodiments, B is

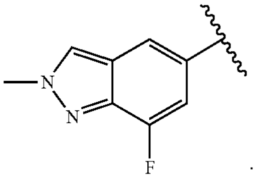 [SMILES: *c1cc(F)c2nn(C)cc2c1]

.

In some embodiments, B is

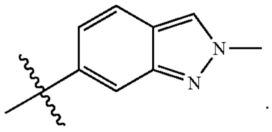 [SMILES: *c1ccc2cn(C)nc2c1]

.

In some embodiments, B is

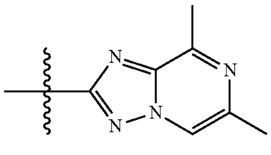

.

In some embodiments, B is

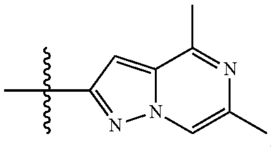

.

In some embodiments, B is

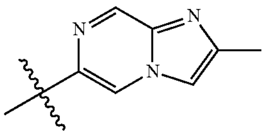

.

In some embodiments, B is

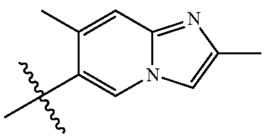

.

In some embodiments, B is

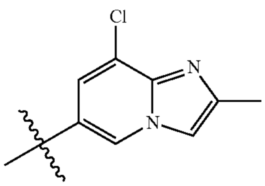

.

In some embodiments, B is

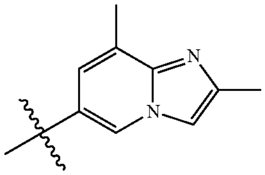

.

In some embodiments, B is

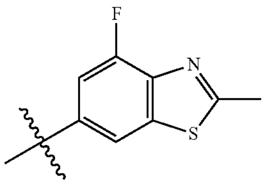

.

In some embodiments, B is

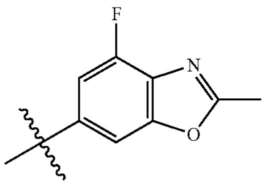

.

As generally described herein, $L^1$ and $L^2$ each independently may be absent or refer to a $C_1$-$C_6$-alkylene, $C_1$-$C_6$-heteroalkylene, —O—, —C(O)—, —N($R^4$)—, —N($R^4$)C(O)—, or —C(O)N($R^4$)— group, wherein each alkylene and heteroalkylene is optionally substituted with one or more $R^5$.

In some embodiments, $L^1$ is absent. In some embodiments, $L^1$ is $C_1$-$C_6$-alkylene (e.g., $C_1$-alkylene, $C_2$-alkylene, $C_3$-alkylene, $C_4$-alkylene, $C_5$-alkylene, or $C_6$-alkylene). In some embodiments, $L^1$ is unsubstituted $C_1$-$C_6$ alkylene. In some embodiments, $L^1$ is substituted $C_1$-$C_6$-alkylene, e.g., $C_1$-$C_6$ alkylene substituted with one or more $R^5$. In some embodiments, $L^1$ is $C_1$-alkylene substituted with one $R^5$. In some embodiments, $L^1$ is —$CH_2$— (or methylene). In some embodiments, $L^1$ is —C(O)— (or carbonyl).

In some embodiments, $L^1$ is absent, $C_1$-$C_6$-alkylene, $C_1$-$C_6$-heteroalkylene, —N($R^4$)C(O)—, or —C(O)N($R^4$)—, wherein each alkylene and heteroalkylene is optionally substituted with one or more $R^5$.

In some embodiments, $L^1$ is $C_1$-$C_6$ heteroalkylene (e.g., $C_1$-heteroalkylene, $C_2$-heteroalkylene, $C_3$-heteroalkylene, $C_4$-heteroalkylene, $C_5$-heteroalkylene, or $C_6$-heteroalkylene). In some embodiments, $L^1$ is unsubstituted $C_1$-$C_6$ heteroalkylene. In some embodiments, $L^1$ is substituted heteroalkylene, e.g., $C_1$-$C_6$ heteroalkylene substituted with one or more $R^5$. In some embodiments, the heteroalkylene comprises 1 or more heteroatoms. In some embodiments, the heteroalkylene comprises one or more of oxygen, sulfur, nitrogen, boron, silicon, or phosphorus. In some embodiments, $L^1$ is —N($R^4$)C(O)—. In some embodiments, $L^1$ is —C(O)N($R^4$)—. In some embodiments, $L^1$ is —C(O)N(H)—.

In some embodiments, $L^1$ is oxygen. In some embodiments, $L^1$ is nitrogen which is optionally substituted with $R^4$.

In some embodiments, $L^1$ is nitrogen substituted with $R^4$. In some embodiments, $L^1$ is —$N(R^4)$—, e.g., —$N(CH_3)$—. In some embodiments, $L^1$ is —NH—. In some embodiments, $L^1$ is —O—.

In some embodiments, $L^2$ is absent, $C_1$-$C_6$-alkylene, $C_1$-$C_6$-heteroalkylene, —$N(R^4)C(O)$—, or —$C(O)N(R^4)$—, wherein each alkylene and heteroalkylene is optionally substituted with one or more $R^5$. In some embodiments, $L^2$ is unsubstituted $C_1$-$C_6$ heteroalkylene. In some embodiments, $L^2$ is substituted heteroalkylene, e.g., $C_1$-$C_6$ heteroalkylene substituted with one or more $R^5$. In some embodiments, the heteroalkylene comprises 1 or more heteroatoms. In some embodiments, the heteroalkylene comprises one or more of oxygen, sulfur, nitrogen, boron, silicon, or phosphorus. In some embodiments, $L^2$ is —$N(R^4)C(O)$—. In some embodiments, $L^2$ is —$C(O)N(R^4)$—. In some embodiments, $L^2$ is —C(O)N(H)—.

In some embodiments, $L^2$ is nitrogen which is optionally substituted with $R^4$. In some embodiments, $L^2$ is nitrogen substituted with $R^4$. In some embodiments, $L^2$ is —$N(R^4)$—, e.g., —$N(CH_3)$—. In some embodiments, $L^2$ is —NH—.

As generally described herein, X, Y, and Z each independently refer to $C(R^{3a})$, $C(R^{3a})(R^{3b})$, N, or $N(R^{3c})$, or O, and W refers to $C(R^{3a})$, $C(R^{3a})(R^{3b})$, N, or $N(R^{3c})$. In some embodiments, at least one of X, Y, and Z is either N or $N(R^{3c})$. In some embodiments, at least one of X, Y, and Z is O. In some embodiments, at least two of X, Y, and Z is N or $N(R^{3c})$. In some embodiments, X is N. In some embodiments, X is $N(R^{3c})$. In some embodiments, X is O. In some embodiments, X is $C(R^{3a})$ (e.g., CH). In some embodiments, X is $C(R^{3a})(R^{3b})$. In some embodiments, Y is N. In some embodiments, Y is $N(R^{3c})$. In some embodiments, Y is $C(R^{3a})$ (e.g., CH). In some embodiments, Y is $C(R^{3a})C(R^{3b})$. In some embodiments, Z is N. In some embodiments, Z is $N(R^{3c})$. In some embodiments, Z is $C(R^{3a})$ (e.g., CH). In some embodiments, Z is $C(R^{3a})C(R^{3b})$. In some embodiments, two of X, Y, and Z are N, and the other of X, Y, and Z is $C(R^{3a})$ (e.g., CH). In some embodiments, one of X, Y, and Z is $C(R^{3a})$ (e.g., CH), and the others of X, Y, and Z are each independently N. In some embodiments, X and Y are each independently N, and Z is $C(R^{3a})$ (e.g., CH). In some embodiments, X is $C(R^{3a})$ (e.g., CH), and Y and Z are each independently N.

In some embodiments, X, Y, and Z are each independently N or $C(R^{3a})$, wherein at least one of X, Y, and Z is N and the bonds in the ring comprising X, Y, and Z may be single or double bonds as valency permits.

In some embodiments, X is $C(R^{3a})$, Y is $C(R^{3a})$, and Z is O. In some embodiments, X is $C(R^{3a})$, Y is $C(R^{3a})$, Z is O, and y is 0. In some embodiments, X is $C(R^{3a})$, Y is $C(R^{3a})$, Z is O, and the bond between X and Y is a double bond. In some embodiments, X is $C(R^{3a})$, Y is $C(R^{3a})$, Z is O, and the bond between Y and Z is a single bond.

In some embodiments, y is 0.

In some embodiments, $R^1$ is hydrogen. In some embodiments, $R^1$ is $C_1$-$C_6$-alkyl. In some embodiments, $R^1$ is $C_2$-$C_6$-alkenyl. In some embodiments, $R^1$ is $C_2$-$C_6$-alkynyl. In some embodiments, $R^1$ is $C_1$-$C_6$-heteroalkyl. In some embodiments, $R^1$ is $C_1$-$C_6$-haloalkyl (e.g., —$CF_3$). In some embodiments, $R^1$ is $C_1$-alkyl (e.g., methyl). In some embodiments, $R^1$ is unsubstituted $C_1$-$C_6$-alkyl, unsubstituted $C_2$-$C_6$-alkenyl, unsubstituted $C_2$-$C_6$-alkynyl, unsubstituted $C_1$-$C_6$-heteroalkyl, or unsubstituted $C_1$-$C_6$-haloalkyl. In some embodiments, $R^1$ is $C_1$-$C_6$-alkyl substituted with one or more $R^6$. In some embodiments, $R^1$ is $C_2$-$C_6$-alkenyl substituted with one or more $R^6$. In some embodiments, $R^1$ is $C_2$-$C_6$-alkynyl substituted with one or more $R^6$. In some embodiments, $R^1$ is $C_1$-$C_6$-heteroalkyl substituted with one or more $R^6$. In some embodiments, $R^1$ is $C_1$-$C_6$-haloalkyl substituted with one or more $R^6$. In some embodiments, R, is methyl.

In some embodiments, $R^1$ is cycloalkyl (e.g., 3-7 membered cycloalkyl). In some embodiments, $R^1$ is heterocyclyl (e.g., 3-7 membered heterocyclyl). In some embodiments, $R^1$ is aryl. In some embodiments, $R^1$ is $C_1$-$C_6$ alkylene-aryl (e.g., benzyl). In some embodiments, $R^1$ is $C_1$-$C_6$ alkenylene-aryl. In some embodiments, $R^1$ is $C_1$-$C_6$ alkylene-heteroaryl. In some embodiments, $R^1$ is heteroaryl. In some embodiments, $R^1$ is unsubstituted cycloalkyl, unsubstituted heterocyclyl, unsubstituted aryl, unsubstituted $C_1$-$C_6$ alkylene-aryl, unsubstituted $C_1$-$C_6$ alkenylene-aryl, unsubstituted $C_1$-$C_6$ alkylene-heteroaryl, or unsubstituted heteroaryl. In some embodiments, $R^1$ is cycloalkyl substituted with one or more $R^6$. In some embodiments, $R^1$ is heterocyclyl substituted with one or more $R^6$. In some embodiments, $R^1$ is aryl substituted with one or more $R^6$. In some embodiments, $R^1$ is $C_1$-$C_6$ alkylene-aryl substituted with one or more $R^6$. In some embodiments, $R^1$ is $C_1$-$C_6$ alkenylene-aryl substituted with one or more $R^6$. In some embodiments, $R^1$ is $C_1$-$C_6$ alkylene-heteroaryl substituted with one or more $R^6$. In some embodiments, $R^1$ is heteroaryl substituted with one or more $R^6$.

In some embodiments, $R^1$ is —$OR^A$. In some embodiments, $R^1$ is —$NR^BR^C$ (e.g., $NH_2$ or $NMe_2$). In some embodiments, $R^1$ is —$NR^BC(O)R^D$. In some embodiments, $R^1$ is-$C(O)NR^BR^C$. In some embodiments, $R^1$ is —$C(O)R^D$. In some embodiments, $R^1$ is —$C(O)OR^D$. In some embodiments, $R^1$ is —$SR^E$. In some embodiments, $R^1$ is —$S(O)_x R^D$. In some embodiments, $R^1$ is halo, e.g., fluoro, chloro, bromo, or iodo. In some embodiments, $R^1$ is cyano. In some embodiments, $R^1$ is nitro (—$NO_2$). In some embodiments, $R^1$ is oxo.

In some embodiments, two $R^1$ groups, together with the atoms to which they are attached, form a 3-7-membered cycloalkyl. In some embodiments, two $R^1$ groups, together with the atoms to which they are attached, form a 3-7-membered heterocyclyl. In some embodiments, two R, groups, together with the atoms to which they are attached, form a 5- or 6-membered aryl. In some embodiments, two $R^1$ groups, together with the atoms to which they are attached, form a 5-or 6-membered heteroaryl. The cycloalkyl, heterocyclyl, aryl, or heteroaryl may be substituted with one or more $R^6$.

In some embodiments, $R^2$ is hydrogen. In some embodiments, $R^2$ is halo (e.g., fluoro, chloro, bromo, or iodo). In some embodiments, $R^2$ is cyano. In some embodiments, $R^2$ is $C_1$-$C_6$-alkyl. In some embodiments, $R^2$ is $C_2$-$C_6$-alkenyl. In some embodiments, $R^2$ is $C_2$-$C_6$-alkynyl.

In some embodiments, $R^2$ is —$OR^A$ (e.g., —OH). In some embodiments, $R^{3a}$, $R^{3b}$, or both are independently hydrogen, $C_1$-$C_6$-alkyl, $C_1$-$C_6$-heteroalkyl, $C_1$-$C_6$-haloalkyl, halo, cyano, —$OR^A$, —$NR^BR^C$, —$C(O)R^D$, or —$C(O)OR^D$. In some embodiments, $R^{3a}$ and $R^{3b}$ are each independently hydrogen or $C_1$-$C_6$-alkyl. In some embodiments, $R^{3a}$ is hydrogen. In some embodiments, $R^{3b}$ is hydrogen. In some embodiments, $R^{3a}$ is $C_1$-$C_6$-alkyl (e.g., methyl). In some embodiments, $R^{3b}$ is $C_1$-$C_6$-alkyl (e.g., methyl). In some embodiments, $R^{3a}$ is halo (e.g., fluoro, chloro, bromo, or iodo). In some embodiments, $R^{3b}$ is halo (e.g., fluoro, chloro, bromo, or iodo). In some embodiments, $R^{3a}$ is cyano. In some embodiments, $R^{3b}$ is cyano. In some embodiments, $R^{3a}$ is —$OR^A$ (e.g., —OH). In some embodiments, $R^{3b}$ is —$OR^A$ (e.g., —OH). In some embodiments, $R^{3a}$ is —$NR^B R^C$. In some embodiments, $R^{3b}$ is —$NR^BR^C$. In some embodiments, $R^{3a}$ is —$C(O)R^D$. In some embodiments, $R^{3b}$ is —C(O)$R^D$. In some embodiments, $R^{3a}$ is —C(O)O$R^D$. In some embodiments, $R^{3b}$ is —C(O)O$R^D$.

In some embodiments, each of $R^{3a}$ and $R^{3b}$, together with the carbon atom to which they are attached, form an oxo group.

In some embodiments, $R^{3c}$ is hydrogen. In some embodiments, $R^{3c}$ is $C_1$-$C_6$-alkyl. In some embodiments, $R^{3c}$ is methyl.

In some embodiments, $R^4$ is hydrogen. In some embodiments, $R^4$ is $C_1$-$C_6$ alkyl. In some embodiments, $R^4$ is $C_1$-$C_6$ haloalkyl (e.g., —$CF_3$ or —$CHF_2$). In some embodiments, $R^4$ is methyl.

In some embodiments, $R^5$ is hydrogen. In some embodiments, $R^5$ is $C_1$-$C_6$-alkyl. In some embodiments, $R^5$ is $C_1$-$C_6$-heteroalkyl. In some embodiments, $R^5$ is $C_1$-$C_6$-haloalkyl. In some embodiments, $R^5$ is cycloalkyl. In some embodiments, $R^5$ is halo (e.g., fluoro, chloro, bromo, or iodo). In some embodiments, $R^5$ is cyano. In some embodiments, $R^5$ is oxo. In some embodiments, $R^5$ is —O$R^A$. In some embodiments, $R^5$ is —N$R^B$$R^C$. In some embodiments, $R^5$ is —C(O)$R^D$ or —C(O)O$R^D$.

In some embodiments, $R^6$ is $C_1$-$C_6$-alkyl. In some embodiments, $R^6$ is $C_2$-$C_6$-alkenyl. In some embodiments, $R^6$ is $C_2$-$C_6$-alkynyl. In some embodiments, $R^6$ is $C_1$-$C_6$-heteroalkyl. In some embodiments, $R^6$ is $C_1$-$C_6$-haloalkyl. In some embodiments, $R^6$ is unsubstituted $C_1$-$C_6$-alkyl, unsubstituted $C_2$-$C_6$-alkenyl, unsubstituted $C_2$-$C_6$-alkynyl, unsubstituted $C_1$-$C_6$-haloalkyl, or unsubstituted $C_1$-$C_6$-heteroalkyl. In some embodiments, $R^6$ is $C_1$-$C_6$-alkyl substituted with one or more $R^{11}$. In some embodiments, $R^6$ is $C_2$-$C_6$-alkenyl substituted with one or more $R^{11}$. In some embodiments, $R^6$ is $C_2$-$C_6$-alkynyl substituted with one or more $R^{11}$. In some embodiments, $R^6$ is $C_1$-$C_6$-haloalkyl substituted with one or more $R^{11}$. In some embodiments, $R^6$ is $C_1$-$C_6$-heteroalkyl substituted with one or more $R^{11}$.

In some embodiments, $R^6$ is cycloalkyl. In some embodiments, $R^6$ is heterocyclyl. In some embodiments, $R^6$ is aryl. In some embodiments, $R^6$ is heteroaryl. In some embodiments, $R^6$ is unsubstituted cycloalkyl, unsubstituted heterocyclyl, unsubstituted aryl, or unsubstituted heteroaryl. In some embodiments, $R^6$ is cycloalkyl substituted with one or more $R^{11}$. In some embodiments, $R^6$ is heterocyclyl substituted with one or more $R^{11}$. In some embodiments, $R^6$ is aryl substituted with one or more $R^{11}$. In some embodiments, $R^6$ is heteroaryl substituted with one or more $R^{11}$.

In some embodiments, $R^6$ is halo (e.g., fluoro, chloro, bromo, or iodo). In some embodiments, $R^6$ is cyano. In some embodiments, $R^6$ is oxo. In some embodiments, $R^6$ is —O$R^A$. In some embodiments, $R^6$ is —N$R^B$$R^C$. In some embodiments, $R^6$ is —N$R^B$C(O)$R^D$. In some embodiments, $R^6$ is —$NO_2$. In some embodiments, $R^6$ is —C(O)N$R^B$$R^C$. In some embodiments, $R^6$ is —C(O)$R^D$. In some embodiments, $R^6$ is —C(O)O$R^D$. In some embodiments, $R^6$ is —S$R^E$. In some embodiments, $R^6$ is —$S(O)_x$$R^D$.

In some embodiments, $R^7$ is $C_1$-$C_6$-alkyl. In some embodiments, $R^7$ is halo (e.g., fluoro, chloro, bromo, or iodo). In some embodiments, $R^7$ is cyano. In some embodiments, $R^7$ is oxo. In some embodiments, $R^7$ is —O$R^{A1}$ (e.g., —OH).

In some embodiments, $R^{11}$ is $C_1$-$C_6$-alkyl. In some embodiments, $R^{11}$ is $C_1$-$C_6$-heteroalkyl. In some embodiments, $R^{11}$ is $C_1$-$C_6$-haloalkyl (e.g., —$CF_3$). In some embodiments, $R^{11}$ is cycloalkyl. In some embodiments, $R^{11}$ is heterocyclyl. In some embodiments, $R^{11}$ is aryl. In some embodiments, $R^{11}$ is heteroaryl. In some embodiments, $R^{11}$ is halo. In some embodiments, $R^{11}$ is cyano. In some embodiments, $R^{11}$ is oxo. In some embodiments, $R^{11}$ is —O$R^A$.

In some embodiments, $R^A$ is hydrogen. In some embodiments, $R^A$ is $C_1$-$C_6$ alkyl (e.g., methyl). In some embodiments, $R^A$ is $C_1$-$C_6$ haloalkyl. In some embodiments, $R^A$ is aryl. In some embodiments, $R^A$ is heteroaryl. In some embodiments, $R^A$ is $C_1$-$C_6$ alkylene-aryl (e.g., benzyl). In some embodiments, $R^A$ is $C_1$-$C_6$ alkylene-heteroaryl. In some embodiments, $R^A$ is C(O)$R^D$. In some embodiments, $R^A$ is —$S(O)_x$$R^D$.

In some embodiments, $R^B$, $R^C$, or both are independently hydrogen, $C_1$-$C_6$-alkyl, $C_1$-$C_6$-heteroalkyl, cycloalkyl, heterocyclyl, or —O$R^A$. In some embodiments, each of $R^B$ and $R^C$ is independently hydrogen. In some embodiments, each of $R^B$ and $R^C$ is independently $C_1$-$C_6$ alkyl. In some embodiments, one of $R^B$ and $R^C$ is hydrogen, and the other of $R^B$ and $R^C$ is $C_1$-$C_6$ alkyl. In some embodiments, $R^B$ and $R^C$ together with the atom to which they are attached form a 3-7-membered heterocyclyl ring optionally substituted with one or more of $R^7$.

In some embodiments, $R^D$, $R^E$, or both are independently hydrogen, $C_1$-$C_6$ alkyl, $C_2$-$C_6$ alkenyl, $C_2$-$C_6$ alkynyl, $C_1$-$C_6$ heteroalkyl, $C_1$-$C_6$ haloalkyl, cycloalkyl, heterocyclyl, aryl, heteroaryl, $C_1$-$C_6$ alkylene-aryl (e.g., benzyl), or $C_1$-$C_6$ alkylene-heteroaryl. In some embodiments, each of $R^D$ and $R^E$ is independently hydrogen. In some embodiments, each of $R^D$ and $R^E$ is independently $C_1$-$C_6$ alkyl. In some embodiments, $R^D$ is hydrogen. In some embodiments, $R^E$ is hydrogen. In some embodiments, $R^D$ is $C_1$-$C_6$ alkyl (e.g., methyl). In some embodiments, $R^E$ is $C_1$-$C_6$ alkyl (e.g., methyl). In some embodiments, $R^D$ is $C_1$-$C_6$ heteroalkyl. In some embodiments, $R^E$ is $C_1$-$C_6$ heteroalkyl. In some embodiments, $R^D$ is $C_1$-$C_6$ haloalkyl. In some embodiments, $R^E$ is $C_1$-$C_6$ haloalkyl. In some embodiments, $R^D$ is cycloalkyl. In some embodiments, $R^E$ is cycloalkyl. In some embodiments, $R^D$ is heterocyclyl. In some embodiments, $R^E$ is heterocyclyl. In some embodiments, $R^D$ is aryl. In some embodiments, $R^E$ is aryl. In some embodiments, $R^D$ is heteroaryl. In some embodiments, $R^E$ is heteroaryl. In some embodiments, $R^D$ is $C_1$-$C_6$ alkylene-aryl (e.g., benzyl). In some embodiments, $R^E$ is $C_1$-$C_6$ alkylene-aryl (e.g., benzyl). In some embodiments, $R^D$ is $C_1$-$C_6$ alkylene-heteroaryl. In some embodiments, $R^E$ is $C_1$-$C_6$ alkylene-heteroaryl.

In some embodiments, $R^{A1}$ is hydrogen. In some embodiments, $R^{A1}$ is $C_1$-$C_6$-alkyl (e.g., methyl).

In some embodiments, m is 0, 1, or 2. In some embodiments, m is 0. In some embodiments, m is 1. In some embodiments, m is 2. In some embodiments, x is 0, 1, or 2. In some embodiments, x is 0. In some embodiments, x is 1. In some embodiments, x is 2. In some embodiments y is 0 or 1. In some embodiments, y is 0.

In some embodiments, the compound of Formula (I) is a compound of Formula (I-a):

(I-a)

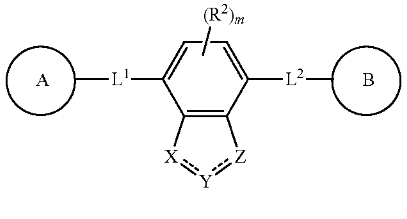

or a pharmaceutically acceptable salt, solvate, hydrate, tautomer, or stereoisomer thereof, wherein:

A and B are each independently cycloalkyl, heterocyclyl, aryl, or heteroaryl, each of which is optionally substituted with one or more $R^1$;

X, Y, and Z are each independently $C(R^{3a})$, $C(R^{3a})(R^{3b})$, N, $N(R^{3c})$, or O, wherein at least one of X, Y, and Z is N, $N(R^{3c})$, or O, and the bonds in the ring comprising X, Y, and Z may be single or double bonds as valency permits;

each of $L^1$ and $L^2$ is independently absent, $C_1$-$C_6$-alkylene, $C_1$-$C_6$-heteroalkylene, —O—, —C(O)—, —$N(R^4)$—, —$N(R^4)C(O)$—, or —$C(O)N(R^4)$—, wherein each alkylene and heteroalkylene is optionally substituted with one or more R;

each $R^1$ is independently hydrogen, $C_1$-$C_6$-alkyl, $C_2$-$C_6$-alkenyl, $C_2$-$C_6$-alkynyl, $C_1$-$C_6$-heteroalkyl, $C_1$-$C_6$-haloalkyl, cycloalkyl, heterocyclyl, aryl, $C_1$-$C_6$ alkylene-aryl, $C_1$-$C_6$ alkenylene-aryl, $C_1$-$C_6$ alkylene-heteroaryl, heteroaryl, halo, cyano, oxo, —$OR^A$, —$NR^BR^C$, —$NR^BC(O)R^D$, —$NO_2$, —$C(O)NR^BR^C$, —$C(O)R^D$, —$C(O)OR^D$, —$SR^E$, or —$S(O)_xR^D$, wherein each alkyl, alkylene, alkenyl, alkynyl, heteroalkyl, haloalkyl, cycloalkyl, heterocyclyl, aryl, and heteroaryl is optionally substituted with one or more $R^6$; or two $R^1$ groups, together with the atoms to which they are attached, form a 3-7-membered cycloalkyl, heterocyclyl, aryl, or heteroaryl, wherein each cycloalkyl, heterocyclyl, aryl, and heteroaryl is optionally substituted with one or more $R^6$;

each $R^2$ is independently hydrogen, $C_1$-$C_6$-alkyl, $C_2$-$C_6$-alkenyl, $C_2$-$C_6$-alkynyl, $C_1$-$C_6$-heteroalkyl, $C_1$-$C_6$-haloalkyl, halo, cyano, or —$OR^A$;

$R^{3a}$ and $R^{3b}$ are each independently hydrogen, $C_1$-$C_6$-alkyl, $C_1$-$C_6$-heteroalkyl, $C_1$-$C_6$-haloalkyl, halo, cyano, —$OR^A$, —$NR^BR^C$, —$C(O)R^D$, or —$C(O)OR^D$; or each of $R^{3a}$ and $R^{3b}$, together with the carbon atom to which they are attached, form an oxo group;

$R^{3c}$ is hydrogen or $C_1$-$C_6$-alkyl;

each $R^4$ is independently hydrogen, $C_1$-$C_6$-alkyl, or $C_1$-$C_6$-haloalkyl;

each $R^5$ is independently hydrogen, $C_1$-$C_6$-alkyl, $C_1$-$C_6$-heteroalkyl, $C_1$-$C_6$-haloalkyl, cycloalkyl, halo, cyano, oxo, —$OR^A$, —$NR^BR^C$, —$C(O)R^D$, or —$C(O)OR^D$;

each $R^6$ is independently $C_1$-$C_6$-alkyl, $C_2$-$C_6$-alkenyl, $C_2$-$C_6$-alkynyl, $C_1$-$C_6$-heteroalkyl, $C_1$-$C_6$-haloalkyl, cycloalkyl, heterocyclyl, aryl, heteroaryl, halo, cyano, oxo, —$OR^A$, —$NR^BR^C$, —$NR^BC(O)R^D$, —$NO_2$, —$C(O)NR^BR^C$, —$C(O)R^D$, —$C(O)OR^D$, —$SR^E$, or —$S(O)_xR^D$, wherein each alkyl, alkenyl, alkynyl, heteroalkyl, haloalkyl, cycloalkyl, heterocyclyl, aryl, and heteroaryl is optionally substituted with one or more $R^{11}$;

each $R^7$ is $C_1$-$C_6$-alkyl, halo, cyano, oxo, or —$OR^{A1}$;

each $R^{11}$ is independently $C_1$-$C_6$-alkyl, $C_1$-$C_6$-heteroalkyl, $C_1$-$C_6$-haloalkyl, cycloalkyl, heterocyclyl, aryl, heteroaryl, halo, cyano, oxo, or —$OR^A$;

each $R^A$ is independently hydrogen, $C_1$-$C_6$ alkyl, $C_1$-$C_6$ haloalkyl, aryl, heteroaryl, $C_1$-$C_6$ alkylene-aryl, $C_1$-$C_6$ alkylene-heteroaryl, —$C(O)R^D$, or —$S(O)_xR^D$;

each of $R^B$ and $R^C$ is independently hydrogen, $C_1$-$C_6$ alkyl, $C_1$-$C_6$ heteroalkyl, cycloalkyl, heterocyclyl, or —$OR^A$; or $R^B$ and $R^C$ together with the atom to which they are attached form a 3-7-membered heterocyclyl ring optionally substituted with one or more $R^7$;

each $R^D$ and $R^E$ is independently hydrogen, $C_1$-$C_6$ alkyl, $C_2$-$C_6$ alkenyl, $C_2$-$C_6$ alkynyl, $C_1$-$C_6$ heteroalkyl, $C_1$-$C_6$ haloalkyl, cycloalkyl, heterocyclyl, aryl, heteroaryl, $C_1$-$C_6$ alkylene-aryl, or $C_1$-$C_6$ alkylene-heteroaryl;

each $R^{A1}$ is hydrogen or $C_1$-$C_6$-alkyl;

m is 0, 1, or 2; and x is 0, 1, or 2.

In some embodiments, A is selected from

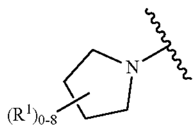, 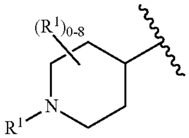,

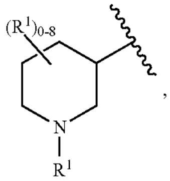, 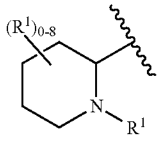, 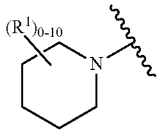,

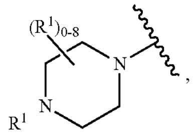, 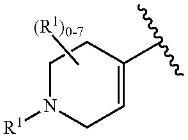,

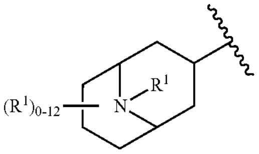, 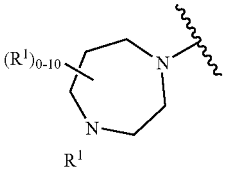,

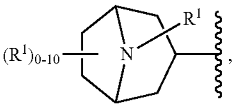, 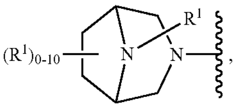,

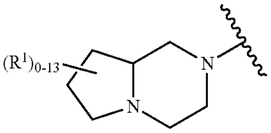, and 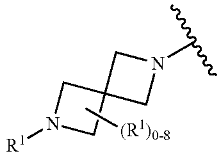, wherein $R^1$ is as defined herein.

In some embodiments, A is selected from

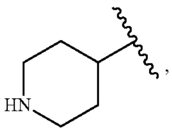, 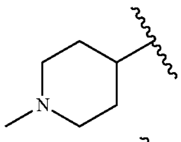,

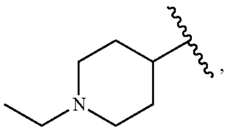, 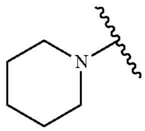,

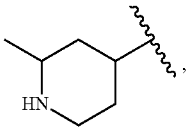, 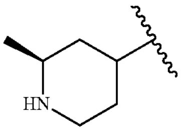,

-continued
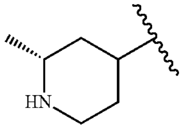
,
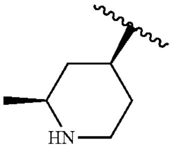
,
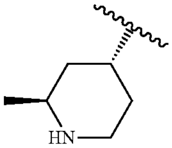
,
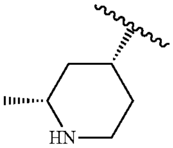
,
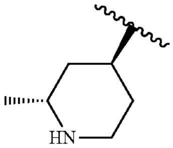
,
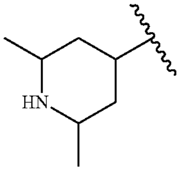
,
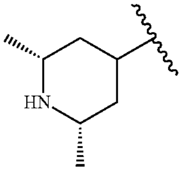
,
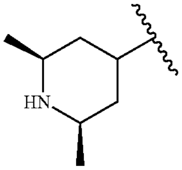
,
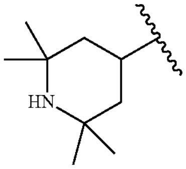
,
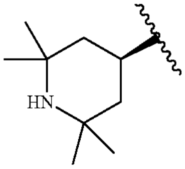
,
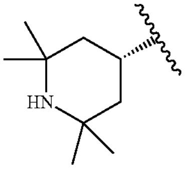
,
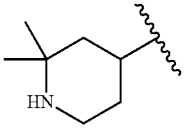
,
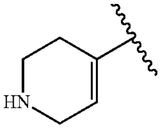
,
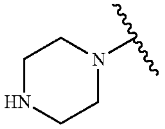
,
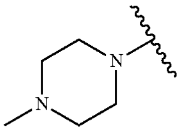
,
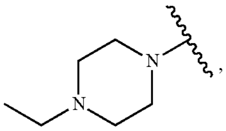
,
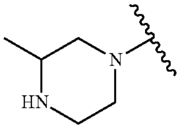
,
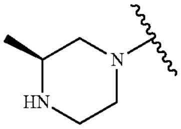
,
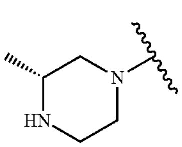
,
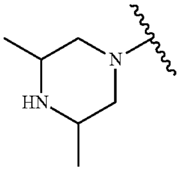
,
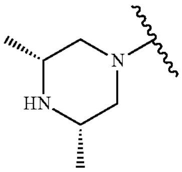
,
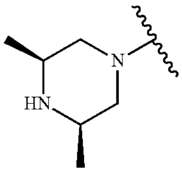
,
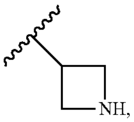
,
-continued
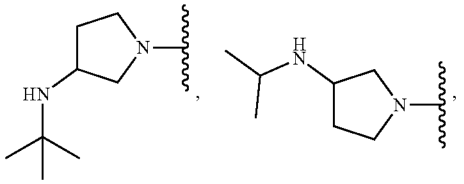
, ,
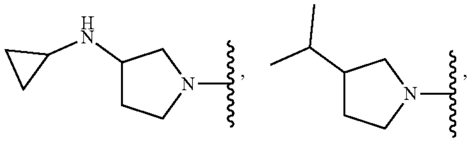
, ,
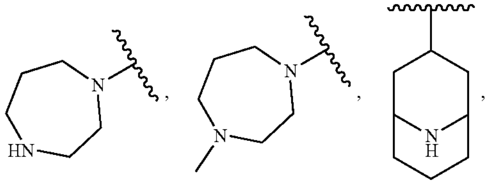
, , ,
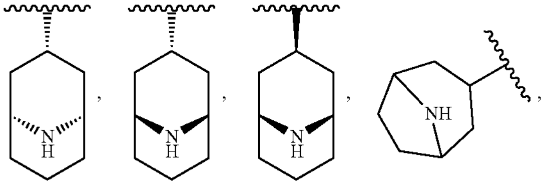
, , , ,
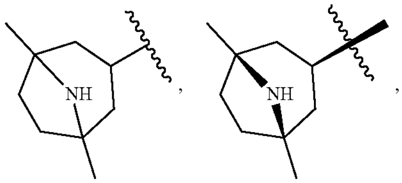
, ,
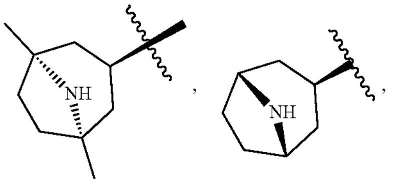
, ,
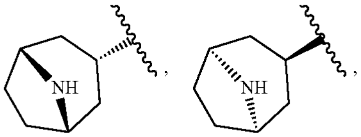
, ,
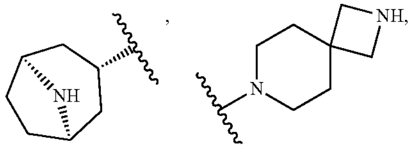
, ,
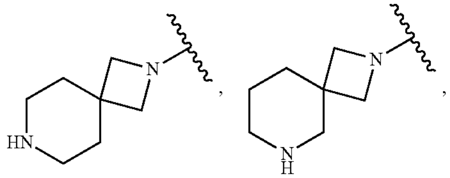
, ,
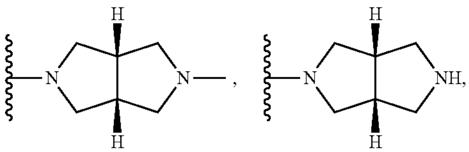
, , -continued
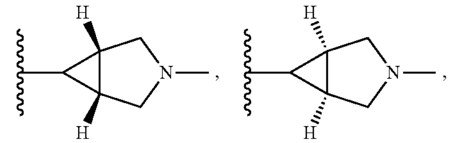,
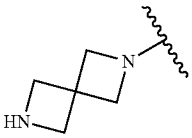,
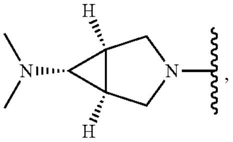
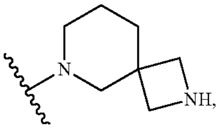,
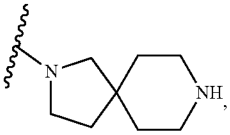,
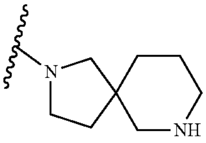,
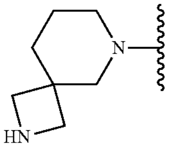,
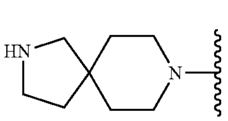,
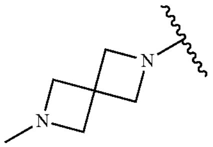, and 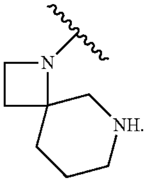.
In some embodiments, A is selected from
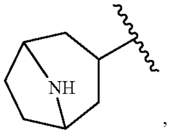, 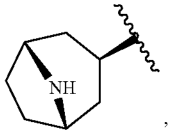, 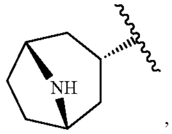,
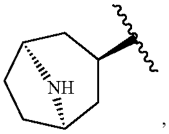, 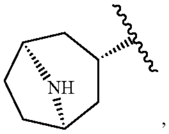, 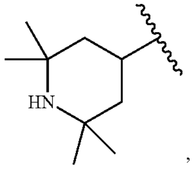,
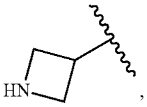, 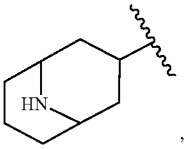, 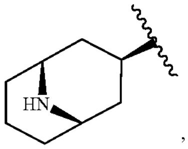,
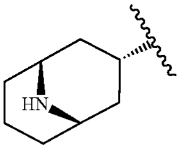, 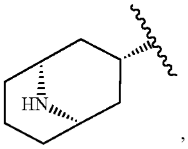, 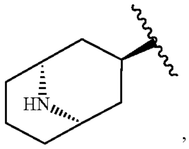,
-continued
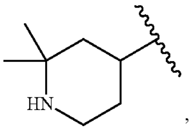, 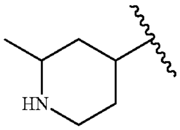, 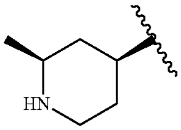,
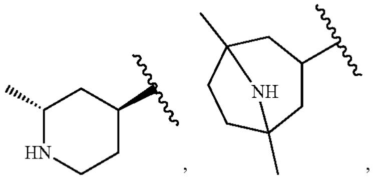,
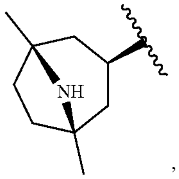, and 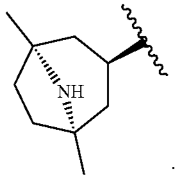.
In some embodiments, A is selected from wherein A is selected from
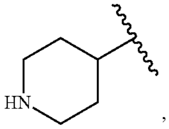, 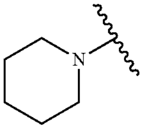, 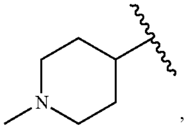,
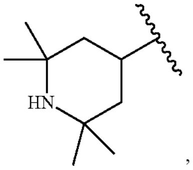, 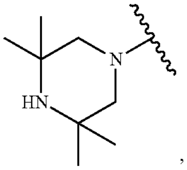,
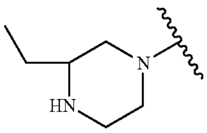, 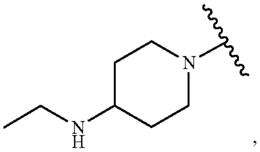,
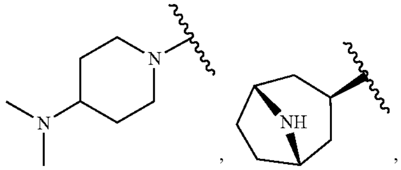,
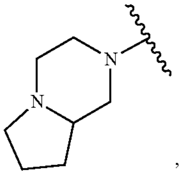, 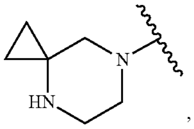, 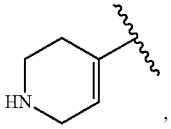,
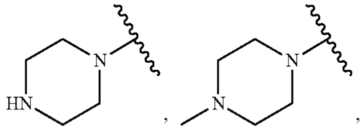, -continued
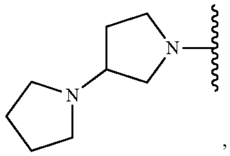
, and
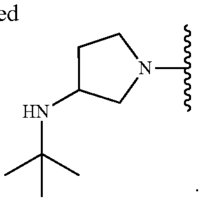
In some embodiments, A is
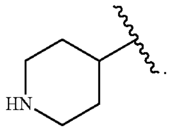
In some embodiments, A is
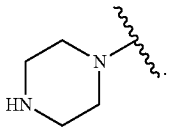
In some embodiments, A is
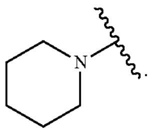 [SMILES: *N1CCCCC1]
In some embodiments, A is
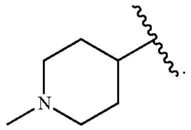 [SMILES: *C1CCN(C)CC1]
In some embodiments, A is
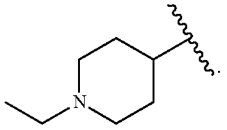 [SMILES: *C1CCN(CC)CC1]
In some embodiments, A is
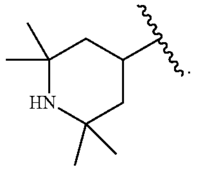 [SMILES: *C1CC(C)(C)NC(C)(C)C1]
In some embodiments, A is
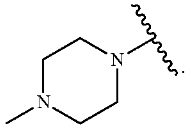 [SMILES: *N1CCN(C)CC1]
In some embodiments, A is
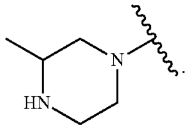 [SMILES: *N1CCNC(C)C1]
In some embodiments, A is
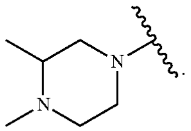 [SMILES: *N1CCN(C)C(C)C1]
In some embodiments, A is
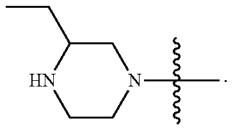 [SMILES: *N1CCNC(CC)C1]
In some embodiments, A is
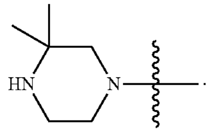 [SMILES: *N1CCNC(C)(C)C1]
In some embodiments, A is
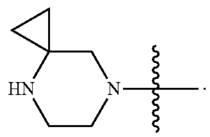 [SMILES: *N1CCNC2(CC2)C1]
In some embodiments, A is
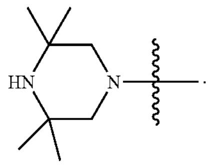 [SMILES: *N1CC(C)(C)NC(C)(C)C1]

In some embodiments, A is
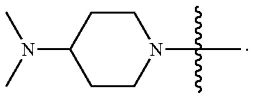 [SMILES: *N1CCC(N(C)C)CC1]
In some embodiments, A is
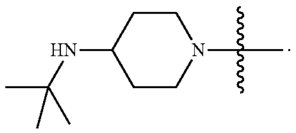 [SMILES: *N1CCC(NC(C)(C)C)CC1]
In some embodiments, A is
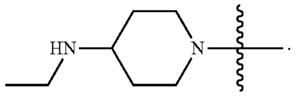 [SMILES: *N1CCC(NCC)CC1]
In some embodiments, A is
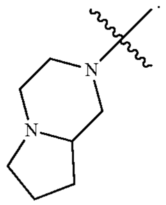 [SMILES: *N1CCN2CCCC2C1]
In some embodiments, A is
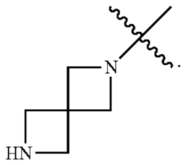 [SMILES: *N1CC2(CNC2)C1]
In some embodiments, A is
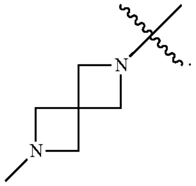 [SMILES: *N1CC2(C1)CN(C)C2]
In some embodiments, A is
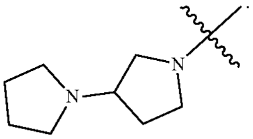 [SMILES: *N1CCC(N2CCCC2)C1]
In some embodiments, A is
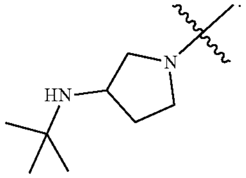 [SMILES: *N1CCC(NC(C)(C)C)C1]
In some embodiments, A is
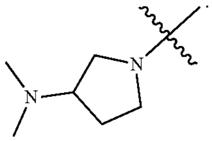 [SMILES: *N1CCC(N(C)C)C1]
In some embodiments, A is
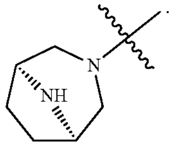 [SMILES: *N1C[C@H]2CC[C@@H](C1)N2]
In some embodiments, A is
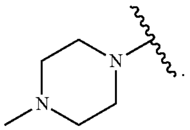 [SMILES: *N1CCN(C)CC1]
In some embodiments, A is
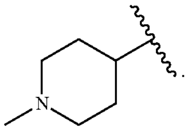 [SMILES: *C1CCN(C)CC1]

In some embodiments, A is
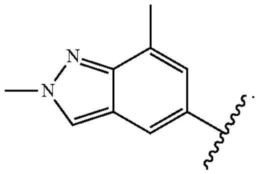 [SMILES: *c1cc(C)c2nn(C)cc2c1].
In some embodiments, A is
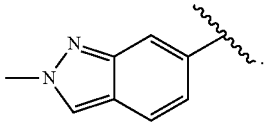 [SMILES: *c1ccc2cn(C)nc2c1].
In some embodiments, B is selected from
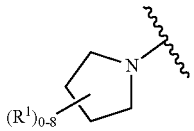, 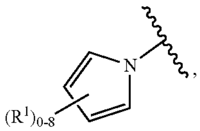, 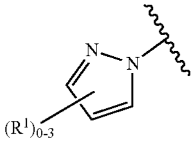, and 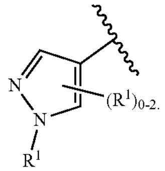.
In some embodiments, B is selected from
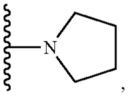, 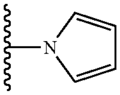, 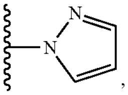, and 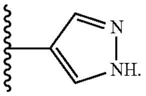.
In some embodiments, B is selected from
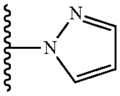, 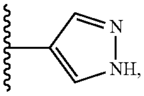, 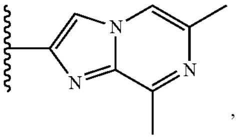, 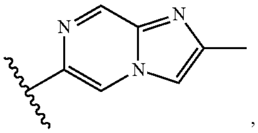, 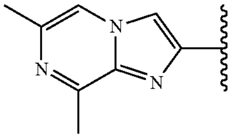,
-continued
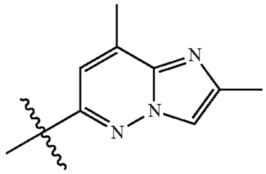, 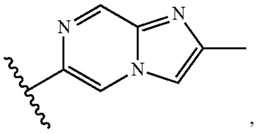, 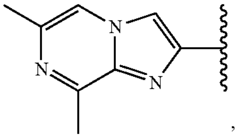, 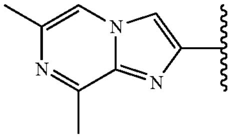, 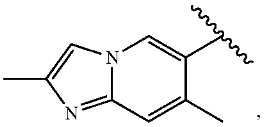, 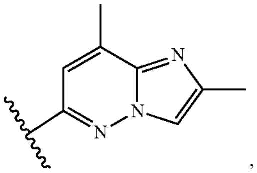, 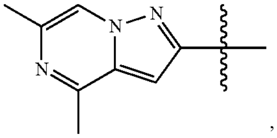, 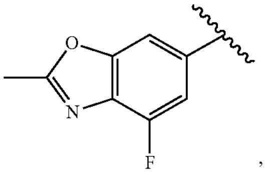, 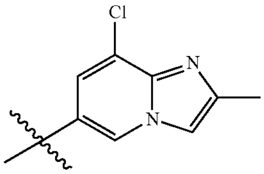, 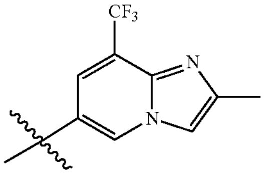, 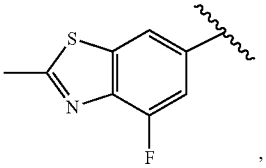, 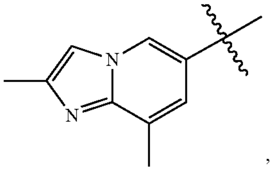, 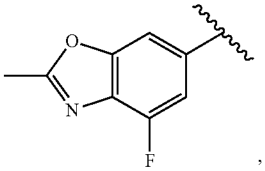, 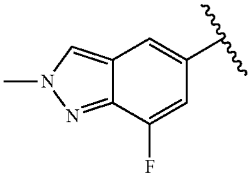, 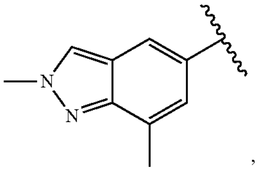, and 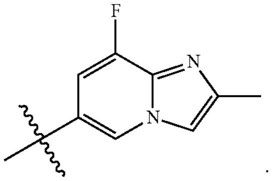.
In some embodiments, B is selected from
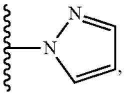, 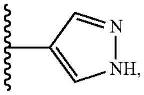, 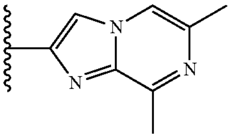, -continued

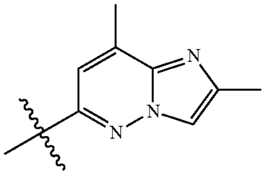

,

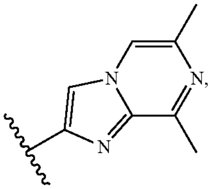

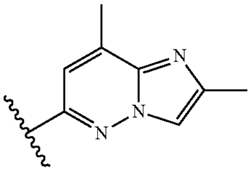

,

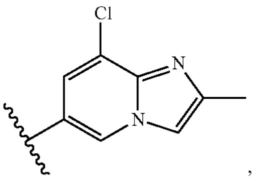

,

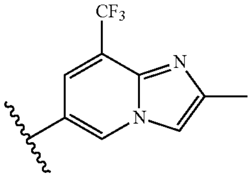

, and

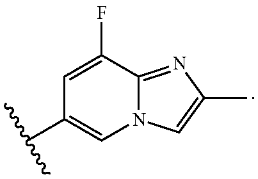

In some embodiments, B is selected is

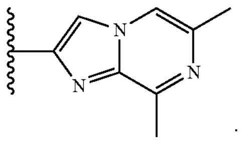 [SMILES: *c1cn2cc(C)nc(C)c2n1]

In some embodiments, B is

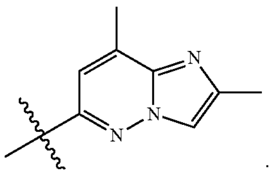 [SMILES: *c1cc(C)c2nc(C)cn2n1]

In some embodiments, B is

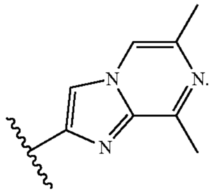 [SMILES: *c1cn2cc(C)nc(C)c2n1]

In some embodiments, B is

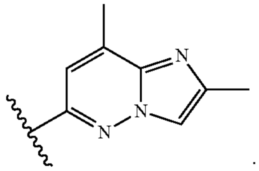 [SMILES: *c1cc(C)c2nc(C)cn2n1]

In some embodiments, B is

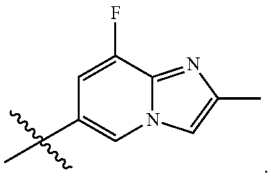 [SMILES: *c1cc(F)c2nc(C)cn2c1]

In some embodiments, X is N. In some embodiments, X is O. In some embodiments, X is $C(R^{3a})$. In some embodiments, Y is N. In some embodiments, Y is $C(R^{3a})$. In some embodiments, Z is $C(R^{3a})$ (e.g., CH). In some embodiments, Z is N. In some embodiments, Z is O. In some embodiments, X and Y are each independently N or $N(R^{3c})$, and Z is $C(R^{3a})$ (e.g., CH). In some embodiments, Y and Z are each independently N or $N(R^{3c})$, and X is $C(R^{3a})$ (e.g., CH). In some embodiments, X is $C(R^{3a})$, Y is $C(R^{3a})$, and Z is O. In some embodiments, Y is $C(R^{3a})$, Z is $C(R^{3a})$, and X is O.

In some embodiments,

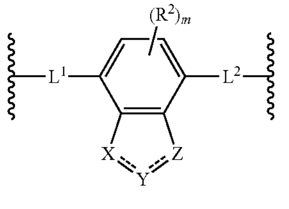

is selected from

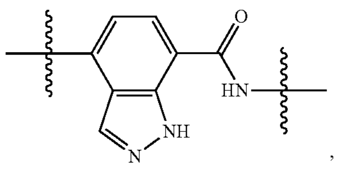

,

-continued

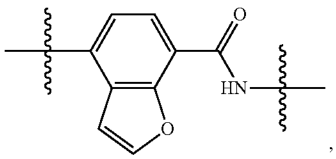

,

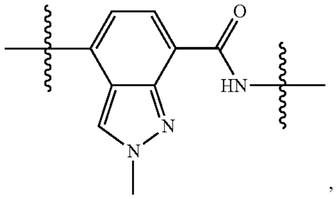

,

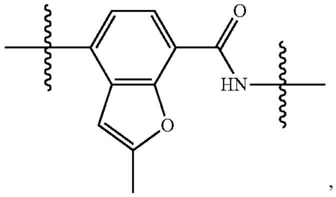

,

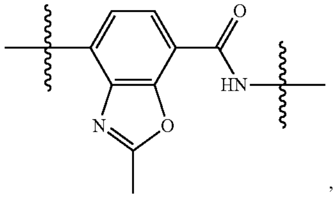

,

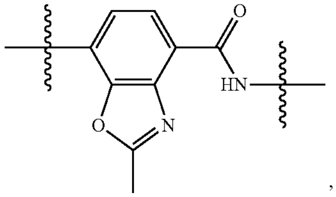

,

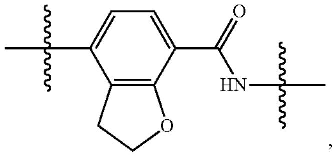

, and

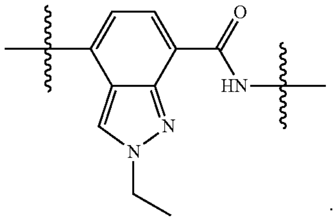

.

In some embodiments,

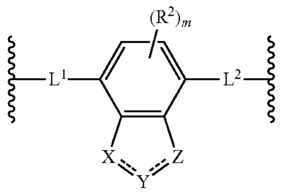

is

-continued

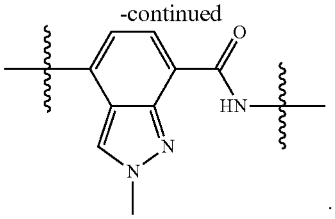

.

In some embodiments,

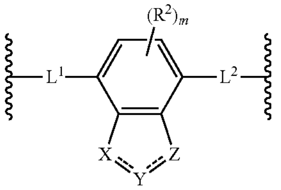

is

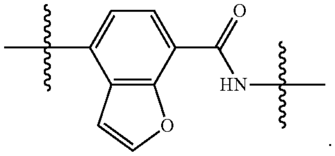

.

In some embodiments, $L^1$ and $L^2$ are each independently absent, —O—, —N($R^4$)—, —N($R^4$)C(O)—, or —C(O)N($R^4$)—. In some embodiments, $L^1$ and $L^2$ are each independently absent. In some embodiments, $L^1$ is absent or —N($R^4$)—. In some embodiments, $L^2$ is absent, —N($R^4$)C(O)—, or —C(O)N($R^4$)—. In some embodiments, $L^2$ is —C(O)N($R^4$)—.

In some embodiments, the compound of Formula (I) is a compound of Formula (I-b):

(I-b)

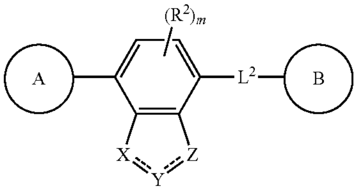

or a pharmaceutically acceptable salt, solvate, hydrate, tautomer, or stereoisomer thereof, wherein:

A and B are each independently cycloalkyl, heterocyclyl, aryl, or heteroaryl, each of which is optionally substituted with one or more $R^1$;

X, Y, and Z are each independently C($R^{3a}$), C($R^{3a}$)($R^{3b}$), N, N($R^{3c}$), or O, wherein at least one of X, Y, and Z is N, N($R^{3c}$), or O, and the bonds in the ring comprising X, Y, and Z may be single or double bonds as valency permits;

$L^2$ is absent, $C_1$-$C_6$-alkylene, $C_1$-$C_6$-heteroalkylene, —O—, —C(O)—, —N($R^4$)—, —N($R^4$)C(O)—, or —C(O)N($R^4$)—, wherein each alkylene and heteroalkylene is optionally substituted with one or more $R^5$;

each $R^1$ is independently hydrogen, $C_1$-$C_6$-alkyl, $C_2$-$C_6$-alkenyl, $C_2$-$C_6$-alkynyl, $C_1$-$C_6$-heteroalkyl, $C_1$-$C_6$-haloalkyl, cycloalkyl, heterocyclyl, aryl, $C_1$-$C_6$ alkylene-aryl, $C_1$-$C_6$ alkenylene-aryl, $C_1$-$C_6$ alkylene-heteroaryl, heteroaryl, halo, cyano, oxo, —$OR^A$, —$NR^BR^C$, —$NR^BC(O)R^D$, —$NO_2$, —$C(O)NR^BR^C$, —$C(O)R^D$, —$C(O)OR^D$, —$SR^E$, or —$S(O)_xR^D$, wherein each alkyl, alkylene, alkenyl, alkynyl, heteroalkyl, haloalkyl, cycloalkyl, heterocyclyl, aryl, and heteroaryl is optionally substituted with one or more $R^6$; or two $R^1$ groups, together with the atoms to which they are attached, form a 3-7-membered cycloalkyl, heterocyclyl, aryl, or heteroaryl, wherein each cycloalkyl, heterocyclyl, aryl, and heteroaryl is optionally substituted with one or more $R^6$;

each $R^2$ is independently hydrogen, $C_1$-$C_6$-alkyl, $C_2$-$C_6$-alkenyl, $C_2$-$C_6$-alkynyl, $C_1$-$C_6$-heteroalkyl, $C_1$-$C_6$-haloalkyl, halo, cyano, or —$OR^A$;

$R^{3a}$ and $R^{3b}$ are each independently hydrogen, $C_1$-$C_6$-alkyl, $C_1$-$C_6$-heteroalkyl, $C_1$-$C_6$-haloalkyl, halo, cyano, —$OR^A$, —$NR^BR^C$, —$C(O)R^D$, or —$C(O)OR^D$; or each of $R^{3a}$ and $R^{3b}$, together with the carbon atom to which they are attached, form an oxo group;

$R^{3c}$ is hydrogen or $C_1$-$C_6$-alkyl;

each $R^4$ is independently hydrogen, $C_1$-$C_6$-alkyl, or $C_1$-$C_6$-haloalkyl;

each $R^5$ is independently hydrogen, $C_1$-$C_6$-alkyl, $C_1$-$C_6$-heteroalkyl, $C_1$-$C_6$-haloalkyl, cycloalkyl, halo, cyano, oxo, —$OR^A$, —$NR^BR^C$, —$C(O)R^D$, or —$C(O)OR^D$;

each $R^6$ is independently $C_1$-$C_6$-alkyl, $C_2$-$C_6$-alkenyl, $C_2$-$C_6$-alkynyl, $C_1$-$C_6$-heteroalkyl, $C_1$-$C_6$-haloalkyl, cycloalkyl, heterocyclyl, aryl, heteroaryl, halo, cyano, oxo, —$OR^A$, —$NR^BR^C$, —$NR^BC(O)R^D$, —$NO_2$, —$C(O)NR^BR^C$, —$C(O)R^D$, —$C(O)OR^D$, —$SR^E$, or —$S(O)_xR^D$, wherein each alkyl, alkenyl, alkynyl, heteroalkyl, haloalkyl, cycloalkyl, heterocyclyl, aryl, and heteroaryl is optionally substituted with one or more $R^1$;

each $R^7$ is $C_1$-$C_6$-alkyl, halo, cyano, oxo, or —$OR^{A1}$;

each $R^{11}$ is independently $C_1$-$C_6$-alkyl, $C_1$-$C_6$-heteroalkyl, $C_1$-$C_6$-haloalkyl, cycloalkyl, heterocyclyl, aryl, heteroaryl, halo, cyano, oxo, or —$OR^A$;

each $R^A$ is independently hydrogen, $C_1$-$C_6$ alkyl, $C_1$-$C_6$ haloalkyl, aryl, heteroaryl, $C_1$-$C_6$ alkylene-aryl, $C_1$-$C_6$ alkylene-heteroaryl, —$C(O)R^D$, or —$S(O)_xR^D$;

each of $R^B$ and $R^C$ is independently hydrogen, $C_1$-$C_6$ alkyl, $C_1$-$C_6$ heteroalkyl, cycloalkyl, heterocyclyl, or —$OR^A$; or $R^B$ and $R^C$ together with the atom to which they are attached form a 3-7-membered heterocyclyl ring optionally substituted with one or more $R^7$;

each $R^D$ and $R^E$ is independently hydrogen, $C_1$-$C_6$ alkyl, $C_2$-$C_6$ alkenyl, $C_2$-$C_6$ alkynyl, $C_1$-$C_6$ heteroalkyl, $C_1$-$C_6$ haloalkyl, cycloalkyl, heterocyclyl, aryl, heteroaryl, $C_1$-$C_6$ alkylene-aryl, or $C_1$-$C_6$ alkylene-heteroaryl;

each $R^{A1}$ is hydrogen or $C_1$-$C_6$-alkyl;

m is 0, 1, or 2; and x is 0, 1, or 2.

In some embodiments, A is heterocyclyl optionally substituted with one or more $R^1$. In some embodiments, A is bicyclic heterocyclyl. In some embodiments, A is monocyclic nitrogen-containing heterocyclyl. In some embodiments, A is bicyclic nitrogen-containing heterocyclyl. In some embodiments, A is optionally substituted piperidinyl. In some embodiments, A is optionally substituted piperazinyl. In some embodiments, A is R

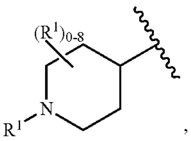
, wherein each $R^1$ is independently hydrogen or $C_1$-$C_6$-alkyl. In some embodiments, A is

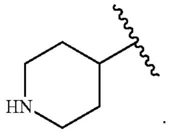
.

In some embodiments, A is

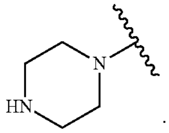
.

In some embodiments, $L^2$ is absent. In some embodiments, $L^2$ is $C_1$-$C_6$-heteroalkylene, that is optionally substituted with one or more $R^5$. In some embodiments, $L^2$ is —$C(O)N(R^4)$—. In some embodiments, $L^2$ is —$C(O)N(H)$—.

In some embodiments, X is N. In some embodiments, X is O. In some embodiments, X is $C(R^{3a})$. In some embodiments, Y is N. In some embodiments, Y is $C(R^{3a})$. In some embodiments, Z is $C(R^{3a})$ (e.g., CH). In some embodiments, Z is N. In some embodiments, Z is O. In some embodiments, X and Y are each independently N or $N(R^{3c})$, and Z is $C(R^{3a})$ (e.g., CH). In some embodiments, Y and Z are each independently N or $N(R^{3c})$, and X is $C(R^{3a})$ (e.g., CH). In some embodiments, X is $C(R^{3a})$, Y is $C(R^{3a})$, and Z is O. In some embodiments, Y is $C(R^{3a})$, Z is $C(R^{3a})$, and X is O.

In some embodiments, A is selected from

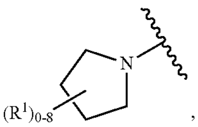
,
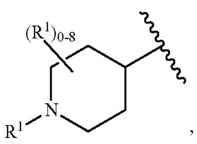
,
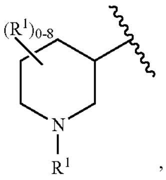
,
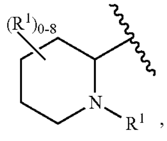
,
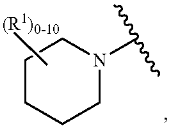
,
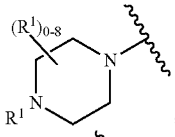
,
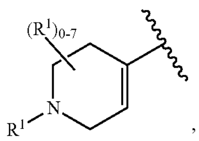
,
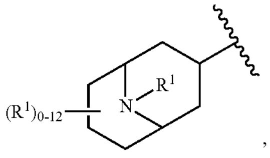
, -continued
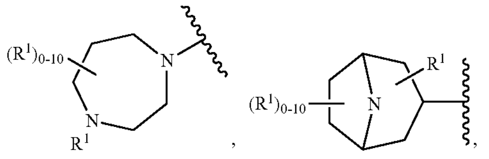
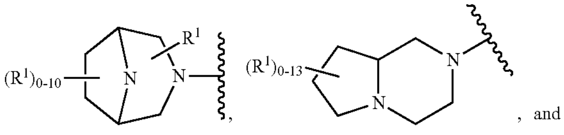
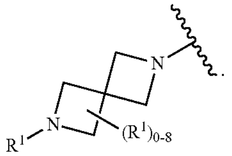
wherein $R^1$ is as defined herein.
In some embodiments, A is selected from
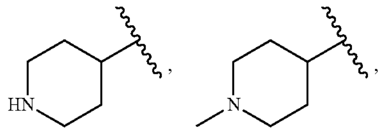
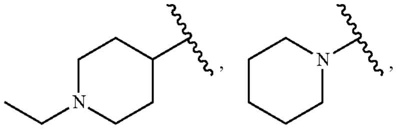
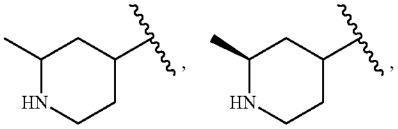
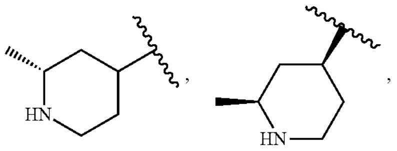
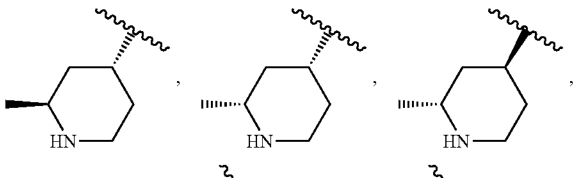
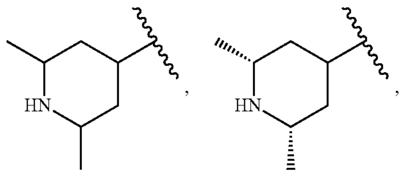
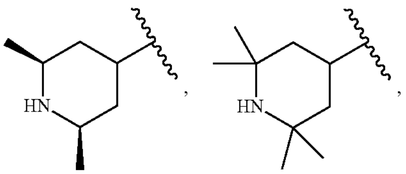
-continued
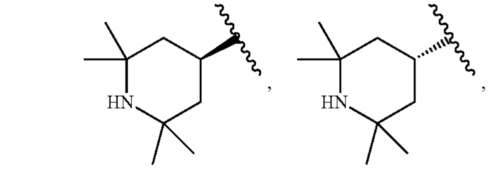
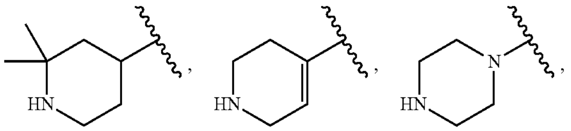
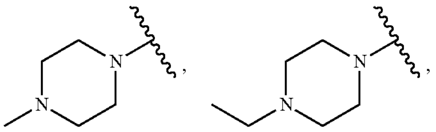
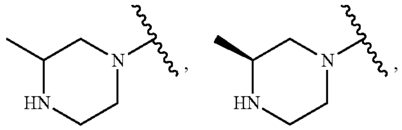
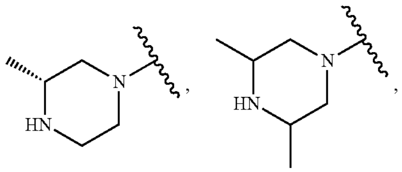
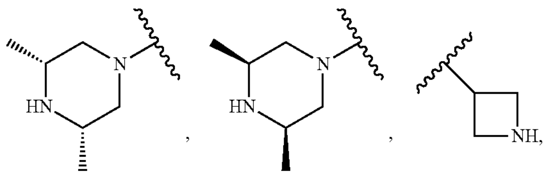
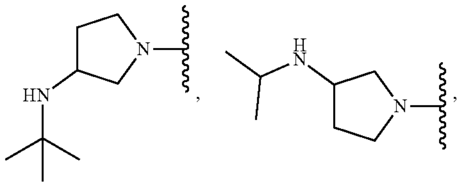
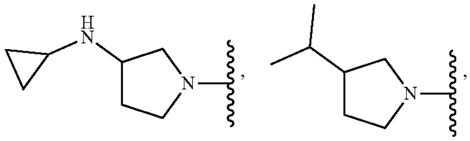
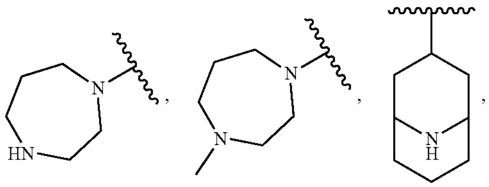
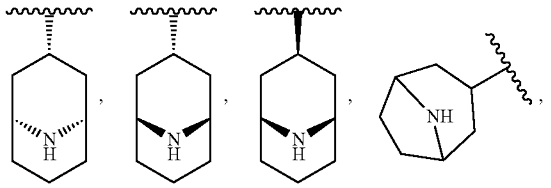

-continued
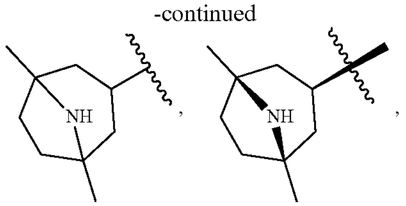
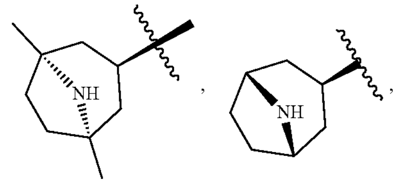
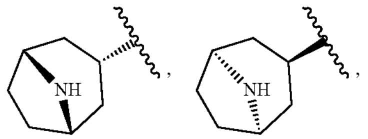
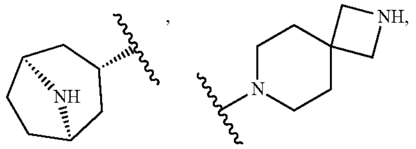
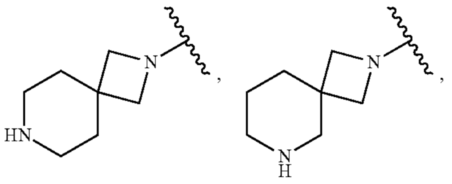
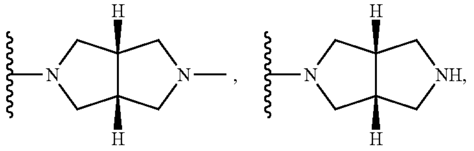
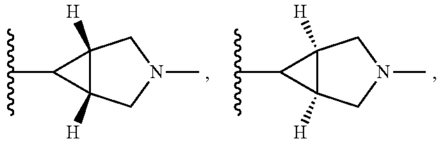
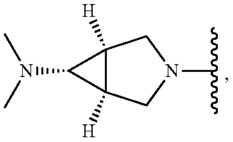
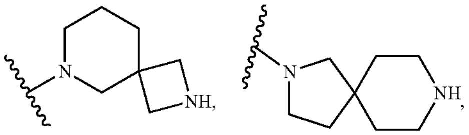
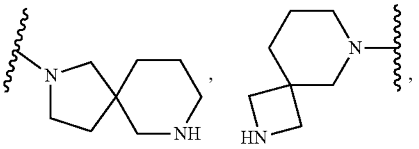
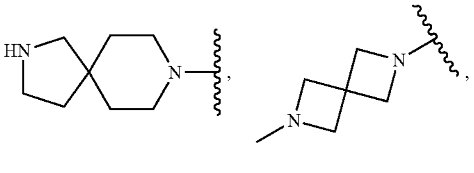
-continued
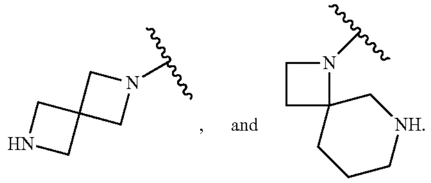
In some embodiments, A is selected from
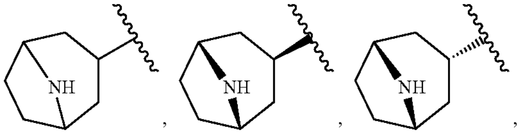
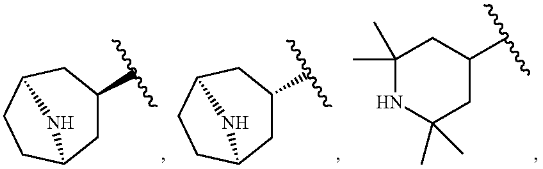
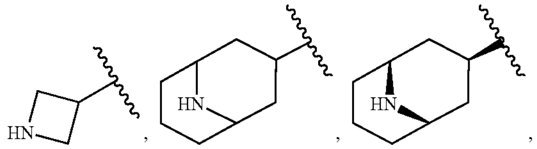
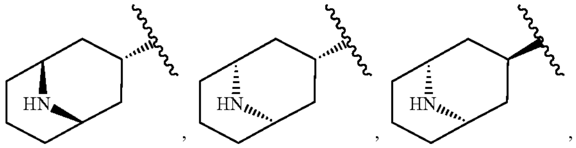
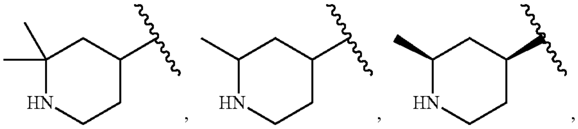
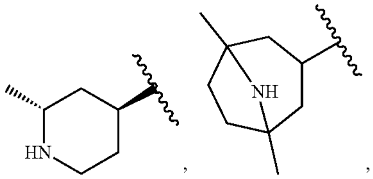
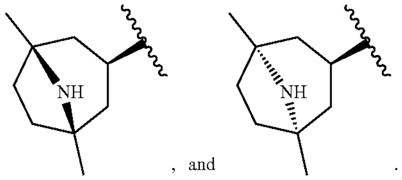
In some embodiments, A is selected from
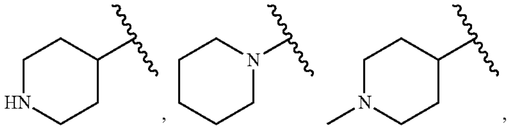

-continued
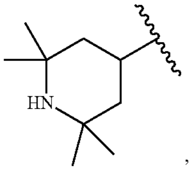,
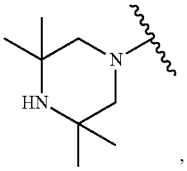,
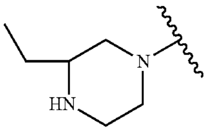,
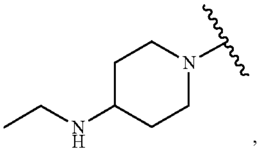,
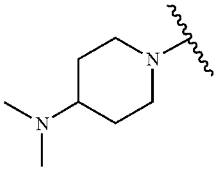,
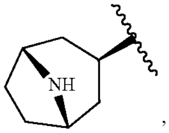,
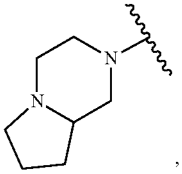,
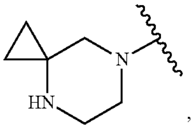,
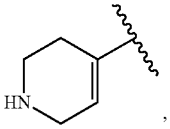,
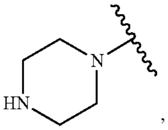,
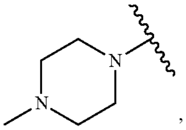,
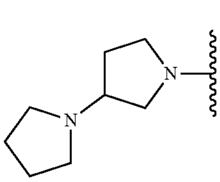, and
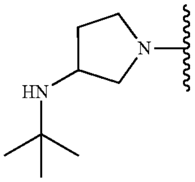.
In some embodiments, A is
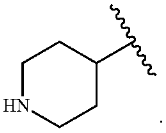.
In some embodiments, A is
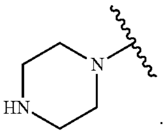.
In some embodiments, A is
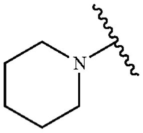.
In some embodiments, A is
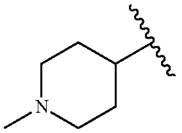.
In some embodiments, A is
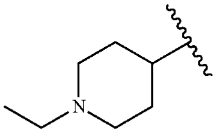.
In some embodiments, A is
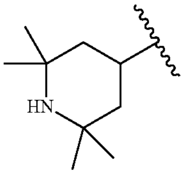.
In some embodiments, A is
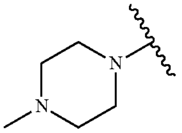.
In some embodiments, A is
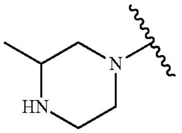.
In some embodiments, A is
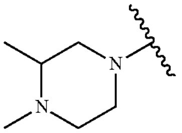.

In some embodiments, A is
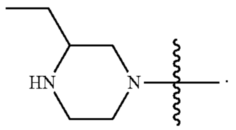 [SMILES: *N1CCNC(CC)C1]
In some embodiments, A is
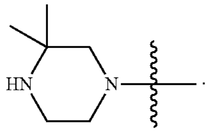
In some embodiments, A is
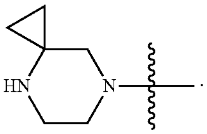
In some embodiments, A is
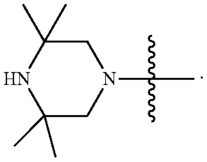
In some embodiments, A is
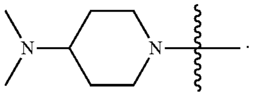
In some embodiments, A is
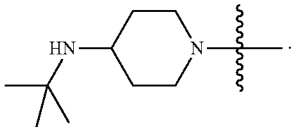
In some embodiments, A is
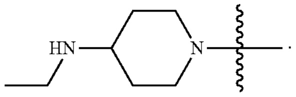
In some embodiments, A is
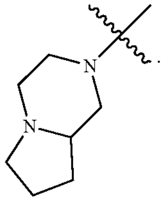
In some embodiments, A is
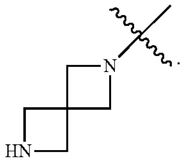
In some embodiments, A is
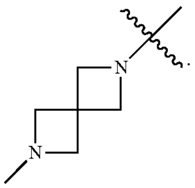 [SMILES: *N1CC2(C1)CN(C)C2]
In some embodiments, A is
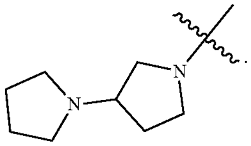 [SMILES: *N1CCC(N2CCCC2)C1]
In some embodiments, A is
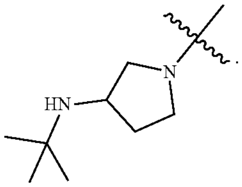 [SMILES: *N1CCC(NC(C)(C)C)C1]
In some embodiments, A is
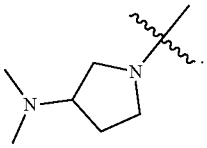 [SMILES: *N1CCC(N(C)C)C1]

In some embodiments, A is
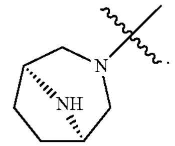 [SMILES: *N1C[C@H]2CC[C@@H](C1)N2]
In some embodiments, A is
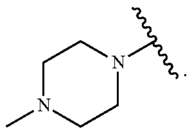 [SMILES: *N1CCN(C)CC1]
In some embodiments, A is
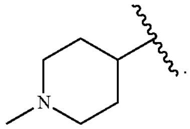 [SMILES: *C1CCN(C)CC1]
In some embodiments, A is
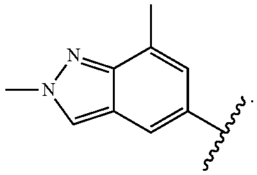 [SMILES: *c1cc(C)c2nn(C)cc2c1]
In some embodiments, A is
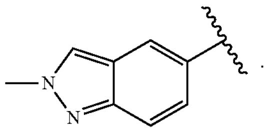 [SMILES: *c1ccc2nn(C)cc2c1]
In some embodiments, B is selected from
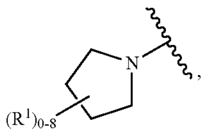, 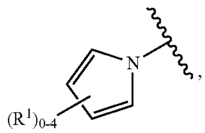, 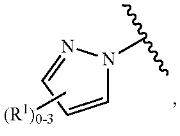, and 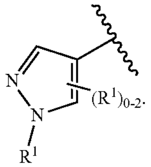
In some embodiments, B is selected from
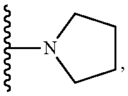, 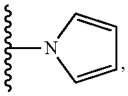, 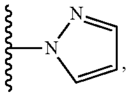, and 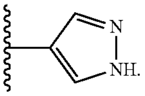
In some embodiments, B is selected from
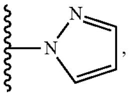, 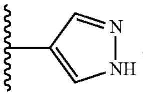, 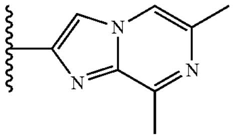, 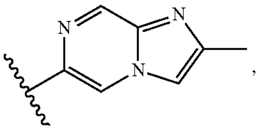, 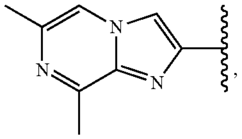, 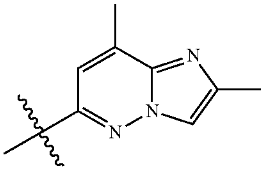, 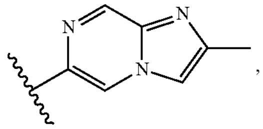, 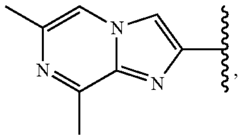, 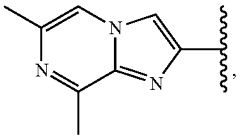, 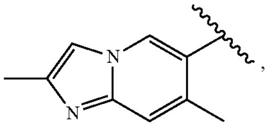, 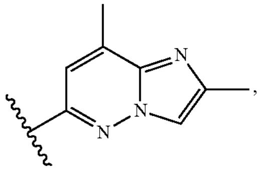, 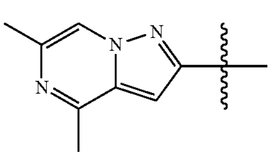, 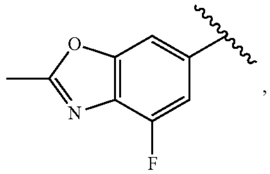, 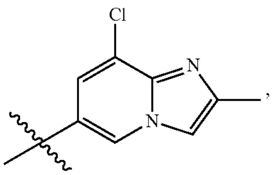, 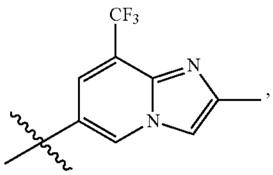, 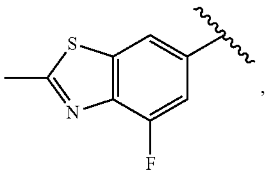, 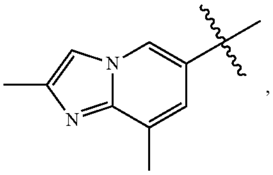, -continued
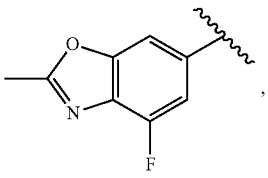
,
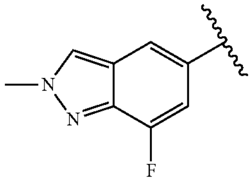
,
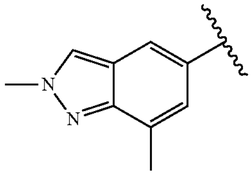
, and
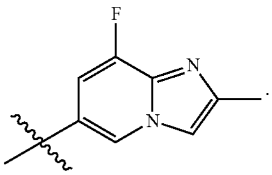
.
In some embodiments, B is selected from
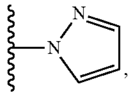
,
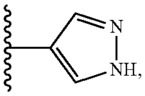
,
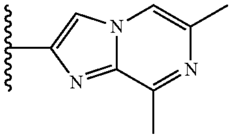
,
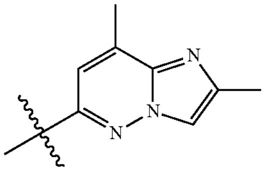
,
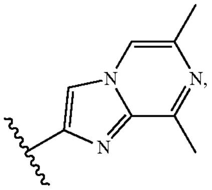
,
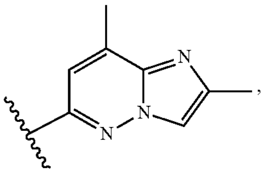
,
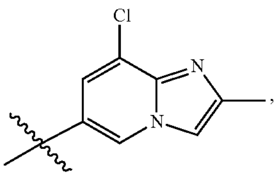
,
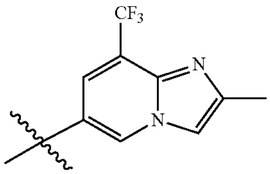
, and
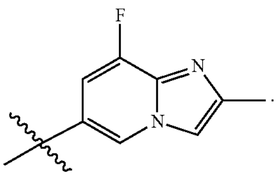
.
In some embodiments, B is selected is
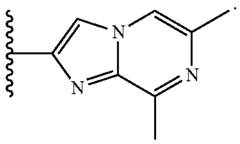 [SMILES: *c1cn2cc(C)nc(C)c2n1]
.
In some embodiments, B is
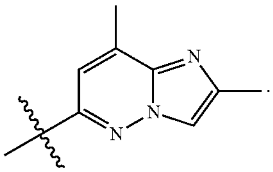 [SMILES: *c1cc(C)c2nc(C)cn2n1]
.
In some embodiments, B is
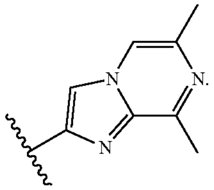 [SMILES: *c1cn2cc(C)nc(C)c2n1]
.
In some embodiments, B is
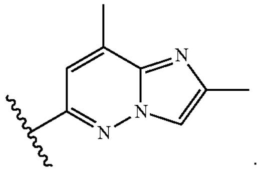 [SMILES: *c1cc(C)c2nc(C)cn2n1]
.
In some embodiments, B is
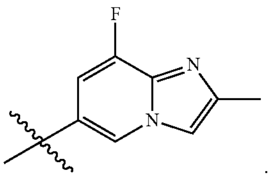 [SMILES: *c1cc(F)c2nc(C)cn2c1]
.
In some embodiments,
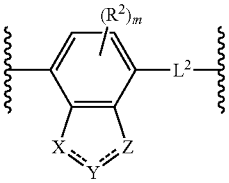
is selected from

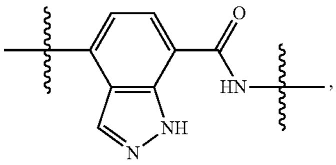,

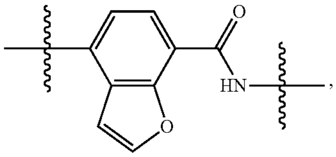,

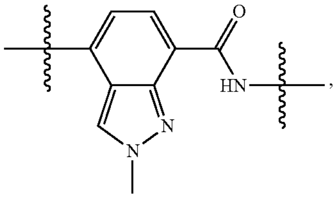,

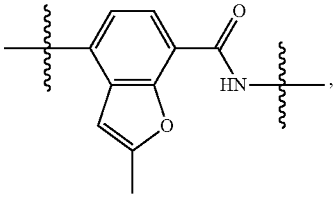,

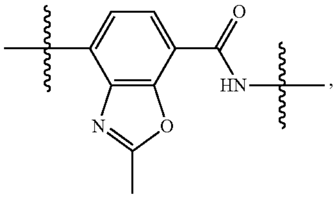,

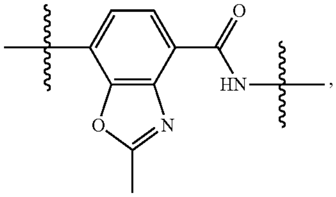,

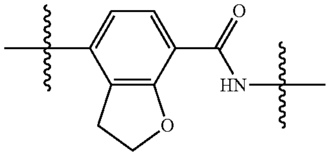, and

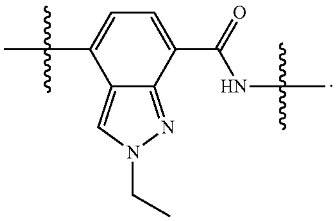.

In some embodiments,

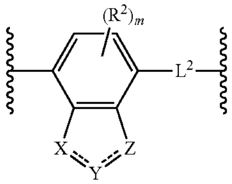

is

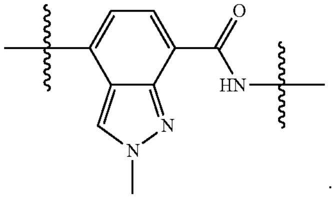.

In some embodiments,

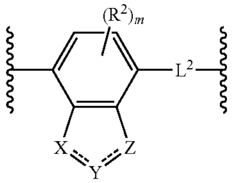

is

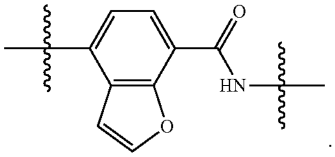.

In some embodiments, the compound of Formula (I) is a compound of Formula (I-c):

(I-c)

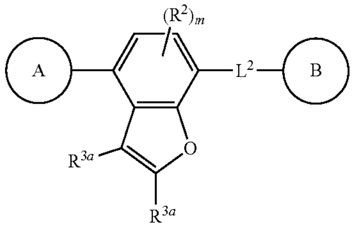

or a pharmaceutically acceptable salt, solvate, hydrate, tautomer, or stereoisomer thereof, wherein:

A and B are each independently cycloalkyl, heterocyclyl, aryl, or heteroaryl, each of which is optionally substituted with one or more $R^1$;

$L^2$ is absent, $C_1$-$C_6$-alkylene, $C_1$-$C_6$-heteroalkylene, —O—, —C(O)—, —$N(R^4)$—, —$N(R^4)C(O)$—, or —$C(O)N(R^4)$—, wherein each alkylene and heteroalkylene is optionally substituted with one or more $R^5$;

each $R^1$ is independently hydrogen, $C_1$-$C_6$-alkyl, $C_2$-$C_6$-alkenyl, $C_2$-$C_6$-alkynyl, $C_1$-$C_6$-heteroalkyl, $C_1$-$C_6$-haloalkyl, cycloalkyl, heterocyclyl, aryl, $C_1$-$C_6$ alkylene-aryl, $C_1$-$C_6$ alkenylene-aryl, $C_1$-$C_6$ alkylene-heteroaryl, heteroaryl, halo, cyano, oxo, —$OR^A$, —$NR^BR^C$, —$NR^BC(O)R^D$, —$NO_2$, —$C(O)NR^BR^C$, —$C(O)R^D$, —$C(O)OR^D$, —$SR^E$, or —$S(O)_xR^D$, wherein each alkyl, alkylene, alkenyl, alkynyl, heteroalkyl, haloalkyl, cycloalkyl, heterocyclyl, aryl, and heteroaryl is optionally substituted with one or more $R^6$; or two $R^1$ groups, together with the atoms to which they are attached, form a 3-7-membered cycloalkyl, heterocyclyl, aryl, or heteroaryl, wherein each cycloalkyl, heterocyclyl, aryl, and heteroaryl is optionally substituted with one or more $R^6$;

each $R^2$ is independently hydrogen, $C_1$-$C_6$-alkyl, $C_2$-$C_6$-alkenyl, $C_2$-$C_6$-alkynyl, $C_1$-$C_6$-heteroalkyl, $C_1$-$C_6$-haloalkyl, halo, cyano, or —$OR^A$;

each $R^{3a}$ is independently hydrogen, $C_1$-$C_6$-alkyl, $C_1$-$C_6$-heteroalkyl, $C_1$-$C_6$-haloalkyl, halo, cyano, —$OR^A$, —$NR^BR^C$, —$C(O)R^D$, or —$C(O)OR^D$;

each $R^4$ is independently hydrogen, $C_1$-$C_6$-alkyl, or $C_1$-$C_6$-haloalkyl;

each $R^5$ is independently hydrogen, $C_1$-$C_6$-alkyl, $C_1$-$C_6$-heteroalkyl, $C_1$-$C_6$-haloalkyl, cycloalkyl, halo, cyano, oxo, —$OR^A$, —$NR^BR^C$, —$C(O)R^D$, or —$C(O)OR^D$;

each $R^6$ is independently $C_1$-$C_6$-alkyl, $C_2$-$C_6$-alkenyl, $C_2$-$C_6$-alkynyl, $C_1$-$C_6$-heteroalkyl, $C_1$-$C_6$-haloalkyl, cycloalkyl, heterocyclyl, aryl, heteroaryl, halo, cyano, oxo, —$OR^A$, —$NR^BR^C$, —$NR^BC(O)R^D$, —$NO_2$, —$C(O)NR^BR^C$, —$C(O)R^D$, —$C(O)OR^D$, —$SR^E$, or —$S(O)_xR^D$, wherein each alkyl, alkenyl, alkynyl, heteroalkyl, haloalkyl, cycloalkyl, heterocyclyl, aryl, and heteroaryl is optionally substituted with one or more $R^{11}$;

each $R^7$ is $C_1$-$C_6$-alkyl, halo, cyano, oxo, or —$OR^{A1}$;

each $R^{11}$ is independently $C_1$-$C_6$-alkyl, $C_1$-$C_6$-heteroalkyl, $C_1$-$C_6$-haloalkyl, cycloalkyl, heterocyclyl, aryl, heteroaryl, halo, cyano, oxo, or —$OR^A$;

each $R^A$ is independently hydrogen, $C_1$-$C_6$ alkyl, $C_1$-$C_6$ haloalkyl, aryl, heteroaryl, $C_1$-$C_6$ alkylene-aryl, $C_1$-$C_6$ alkylene-heteroaryl, —$C(O)R^D$, or —$S(O)_xR^D$;

each of $R^B$ and $R^C$ is independently hydrogen, $C_1$-$C_6$ alkyl, $C_1$-$C_6$ heteroalkyl, cycloalkyl, heterocyclyl, or —$OR^A$; or $R^B$ and $R^C$ together with the atom to which they are attached form a 3-7-membered heterocyclyl ring optionally substituted with one or more $R^7$;

each $R^D$ and $R^E$ is independently hydrogen, $C_1$-$C_6$ alkyl, $C_2$-$C_6$ alkenyl, $C_2$-$C_6$ alkynyl, $C_1$-$C_6$ heteroalkyl, $C_1$-$C_6$ haloalkyl, cycloalkyl, heterocyclyl, aryl, heteroaryl, $C_1$-$C_6$ alkylene-aryl, or $C_1$-$C_6$ alkylene-heteroaryl;

each $R^{A1}$ is hydrogen or $C_1$-$C_6$-alkyl;

m is 0, 1, or 2; and x is 0, 1, or 2.

In some embodiments, A is heterocyclyl optionally substituted with one or more $R^1$. In some embodiments, A is bicyclic heterocyclyl. In some embodiments, A is monocyclic nitrogen-containing heterocyclyl. In some embodiments, A is bicyclic nitrogen-containing heterocyclyl. In some embodiments, A is optionally substituted piperidinyl. In some embodiments, A is optionally substituted piperazinyl. In some embodiments, A is

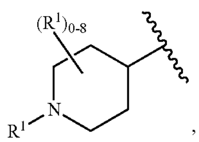

, wherein each $R^1$ is independently hydrogen or $C_1$-$C_6$-alkyl. In some embodiments, A is

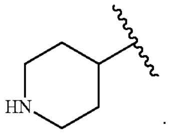

.

In some embodiments, A is

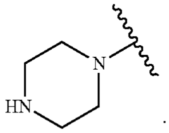 [SMILES: *N1CCNCC1]

.

In some embodiments, $L^2$ is absent. In some embodiments, $L^2$ is $C_1$-$C_6$-heteroalkylene, that is optionally substituted with one or more $R^5$. In some embodiments, $L^2$ is —$C(O)N(R^4)$—. In some embodiments, $L^2$ is —C(O)N(H)—.

In some embodiments, each $R^{3a}$ is independently hydrogen or $C_1$-$C_6$-alkyl (e.g., $CH_3$). In some embodiments, each $R^{3a}$ is independently hydrogen. In some embodiments, each $R^{3a}$ is independently $C_1$-$C_6$-alkyl (e.g., $CH_3$).

In some embodiments, B is heteroaryl optionally substituted with one or more $R^1$. In some embodiments, B is monocyclic heteroaryl. In some embodiments, B is bicyclic heteroaryl. In some embodiments, B is monocyclic nitrogen-containing heteroaryl. In some embodiments, B is bicyclic nitrogen-containing heteroaryl. In some embodiments, B is optionally substituted pyrazolyl. In some embodiments, B is selected from

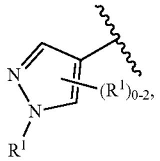

,

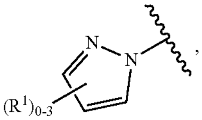

,

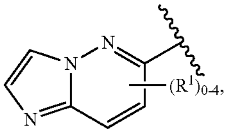

,

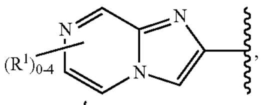

, and

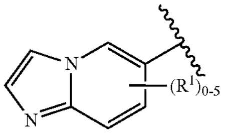

wherein each $R^1$ is as defined above. In some embodiments, B is

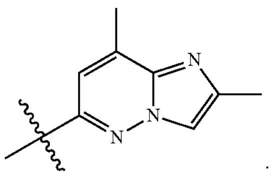 [SMILES: *c1cc(C)c2nc(C)cn2n1]

.

In some embodiments, B is
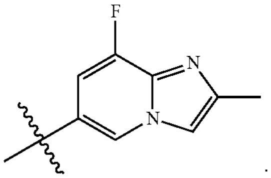 [SMILES: *c1cc(F)c2nc(C)cn2c1]
.
In some embodiments, $R^2$ is $C_1$-$C_6$-alkyl. In some embodiments, $R^2$ is halo (e.g., fluoro). In some embodiments, $R^2$ is —$OR^A$ (e.g., —OH). In some embodiments, $R^{3a}$ is hydrogen. In some embodiments, m is 0.
In some embodiments, A is selected from
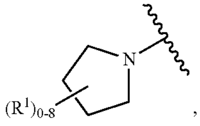
,
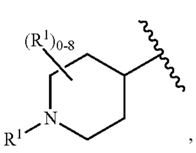
,
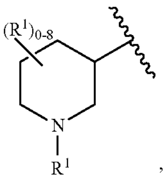
,
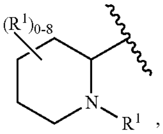
,
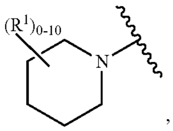
,
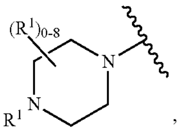
,
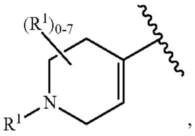
,
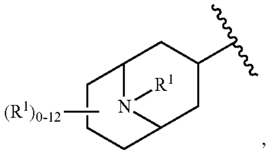
,
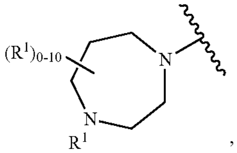
,
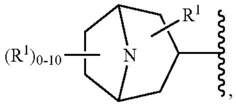
,
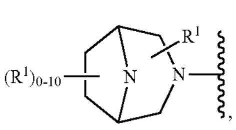
,
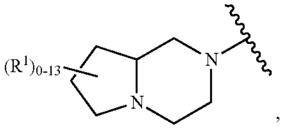
, and
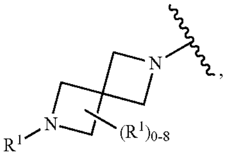
,
wherein $R^1$ is as defined herein.
In some embodiments, A is selected from
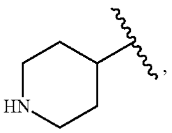
,
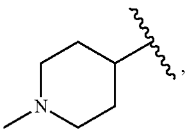
,
-continued
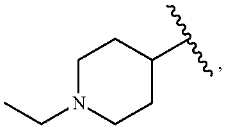
,
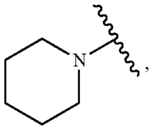
,
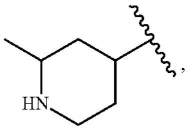
,
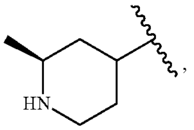
,
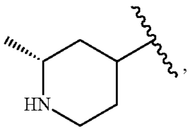
,
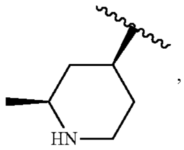
,
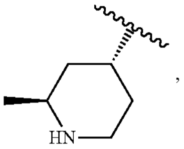
,
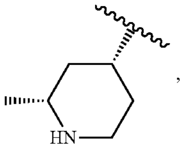
,
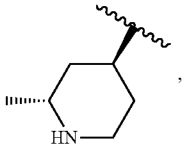
,
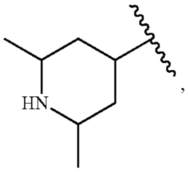
,
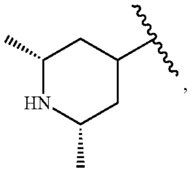
,
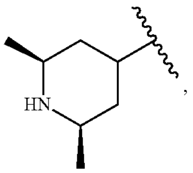
,
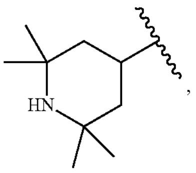
,
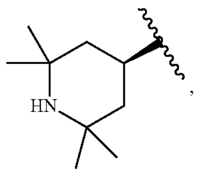
,
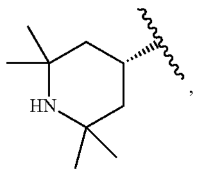
,
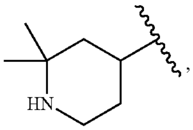
,
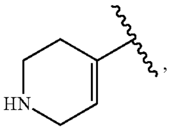
,
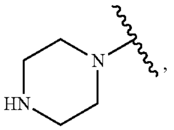
,
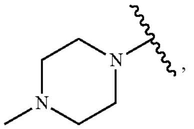
,
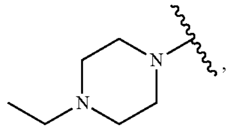
,
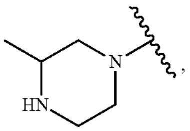
,
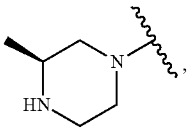
,
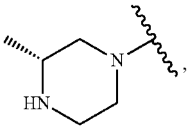
,
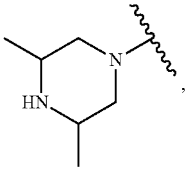
, -continued
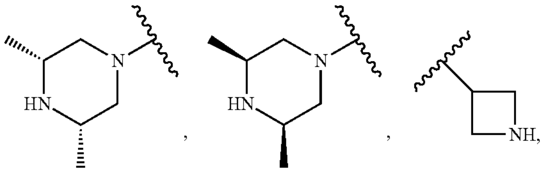
, , 
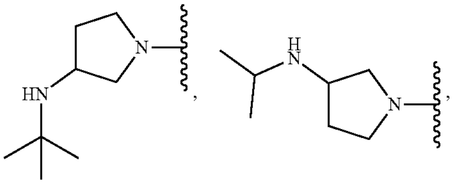
, ,
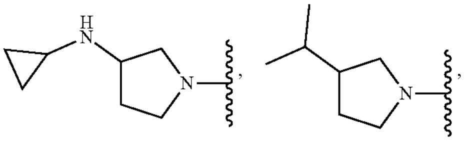
, ,
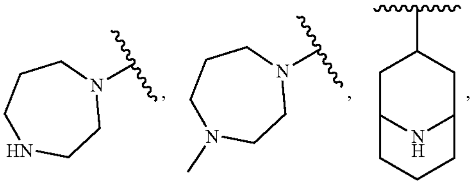
, , ,
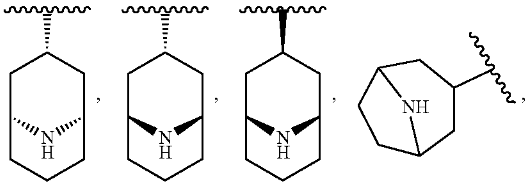
, , , ,
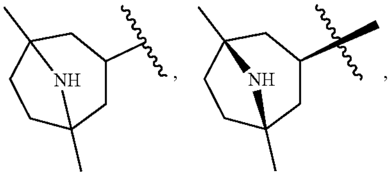
, ,
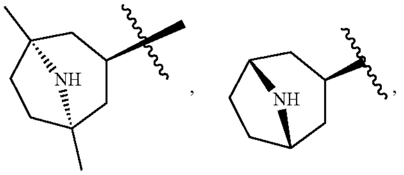
, ,
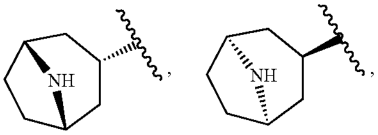
, ,
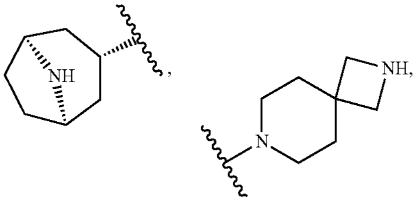
,
-continued
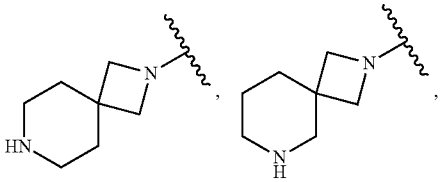
, ,
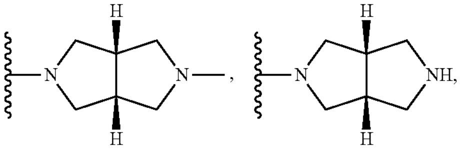
, 
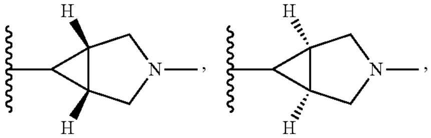
, ,
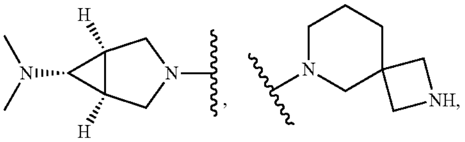
, 
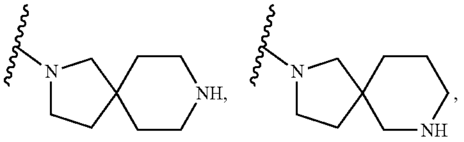
, ,
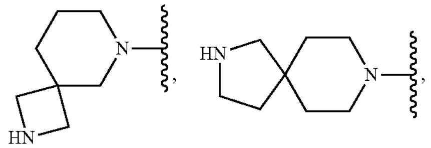
, ,
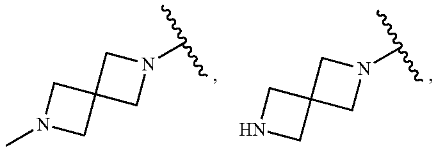
, , and
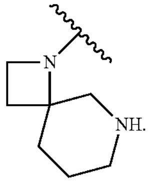
In some embodiments, A is selected from
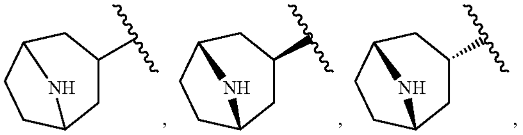
, , ,
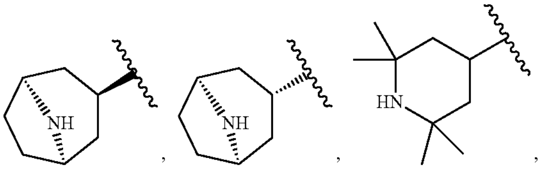
, , , -continued
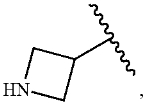, 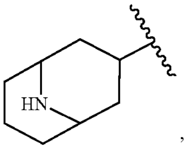, 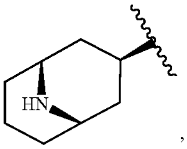,
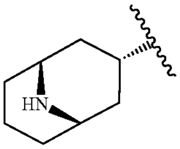, 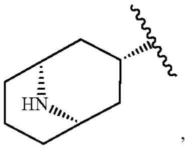, 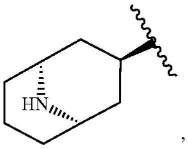,
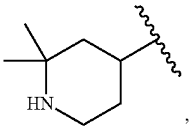, 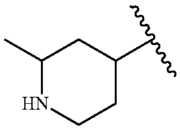, 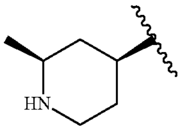,
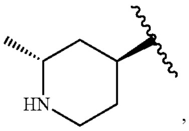, 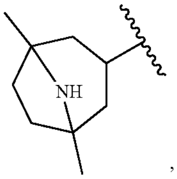,
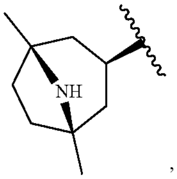, and 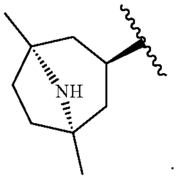.
In some embodiments, A is selected from
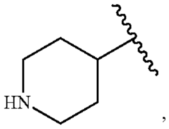, 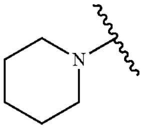, 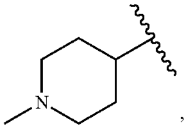,
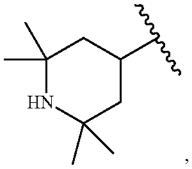, 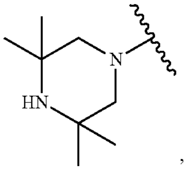,
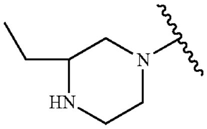, 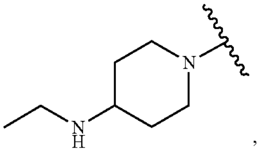,
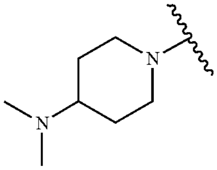, 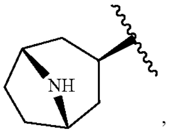,
-continued
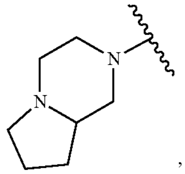, 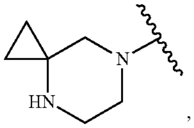, 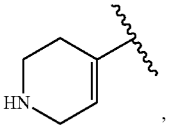,
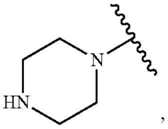, 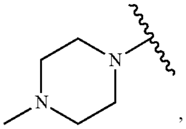,
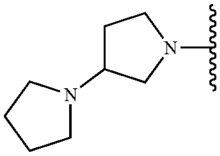, and 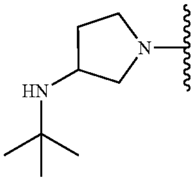.
In some embodiments, A is
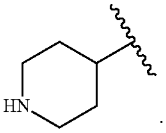.
In some embodiments, A is
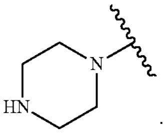 [SMILES: *N1CCNCC1].
In some embodiments, A is
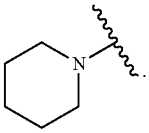 [SMILES: *N1CCCCC1].
In some embodiments, A is
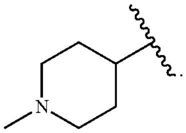.

In some embodiments, A is
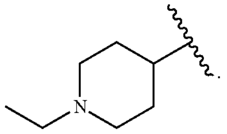 [SMILES: *C1CCN(CC)CC1]
In some embodiments, A is
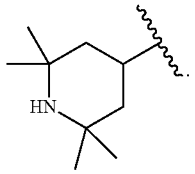 [SMILES: *C1CC(C)(C)NC(C)(C)C1]
In some embodiments, A is
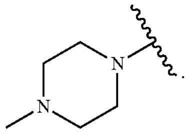
In some embodiments, A is
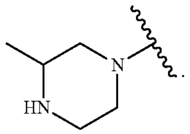 [SMILES: *N1CCNC(C)C1]
In some embodiments, A is
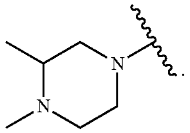
In some embodiments, A is
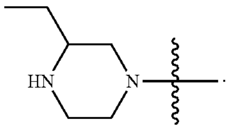 [SMILES: *N1CCNC(CC)C1]
In some embodiments, A is
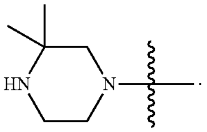
In some embodiments, A is
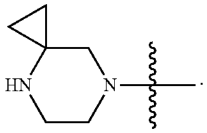
In some embodiments, A is
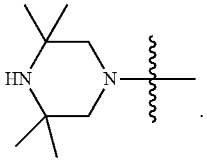 [SMILES: *N1CC(C)(C)NC(C)(C)C1]
In some embodiments, A is
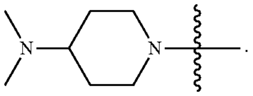 [SMILES: *N1CCC(N(C)C)CC1]
In some embodiments, A is
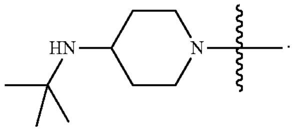 [SMILES: *N1CCC(NC(C)(C)C)CC1]
In some embodiments, A is
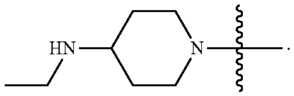 [SMILES: *N1CCC(NCC)CC1]
In some embodiments, A is
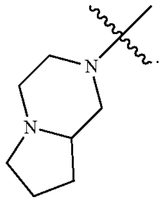 [SMILES: *N1CCN2CCCC2C1]
In some embodiments, A is
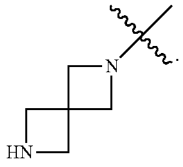

In some embodiments, A is
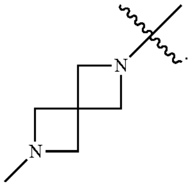 [SMILES: *N1CC2(C1)CN(C)C2]
In some embodiments, A is
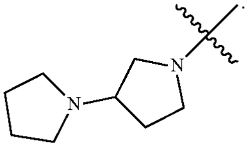 [SMILES: *N1CCC(N2CCCC2)C1]
In some embodiments, A is
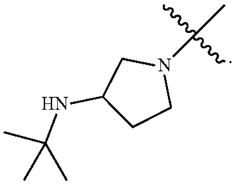 [SMILES: *N1CCC(NC(C)(C)C)C1]
In some embodiments, A is
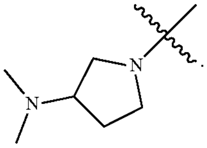 [SMILES: *N1CCC(N(C)C)C1]
In some embodiments, A is
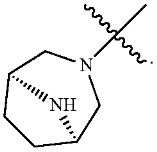 [SMILES: *N1C[C@H]2CC[C@@H](C1)N2]
In some embodiments, A is
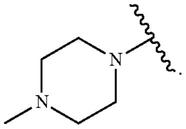 [SMILES: *N1CCN(C)CC1]
In some embodiments, A is
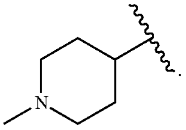 [SMILES: *C1CCN(C)CC1]
In some embodiments, A is
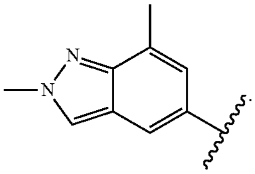 [SMILES: *c1cc(C)c2nn(C)cc2c1]
In some embodiments, A is
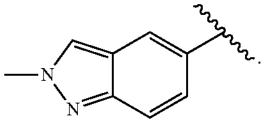 [SMILES: *c1ccc2nn(C)cc2c1]
In some embodiments, B is selected from
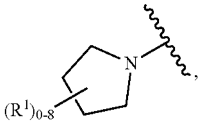, 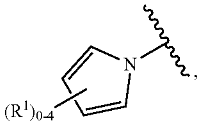, 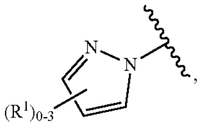, and 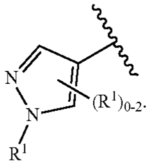
In some embodiments, B is selected from
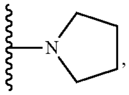, 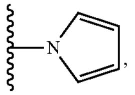, 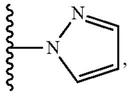, and 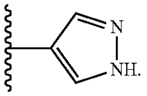
In some embodiments, B is selected from
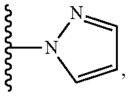, 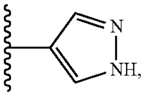, 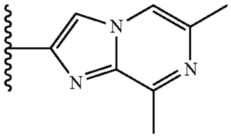, -continued
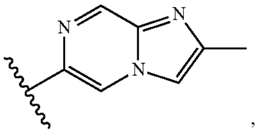,
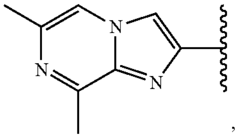,
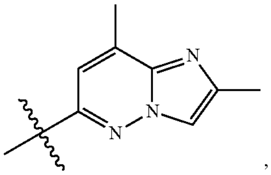,
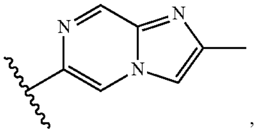,
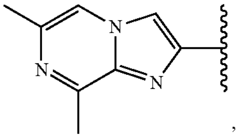,
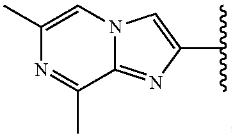,
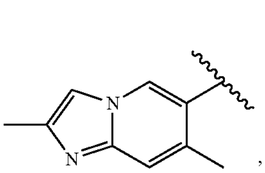,
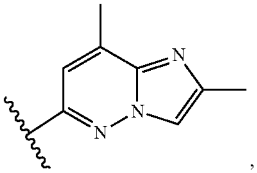,
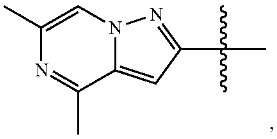,
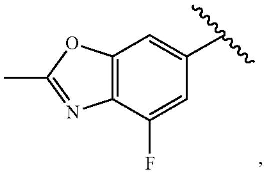,
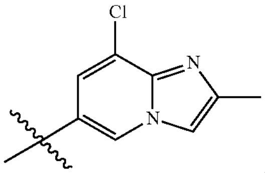,
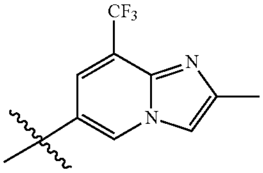,
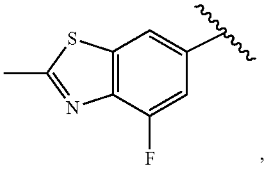,
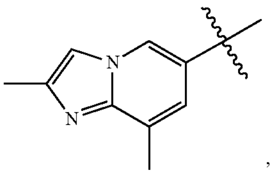,
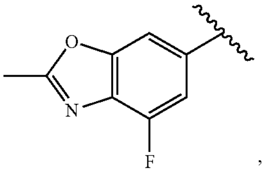,
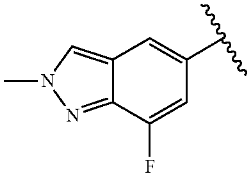,
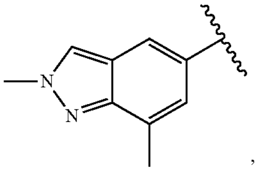, and
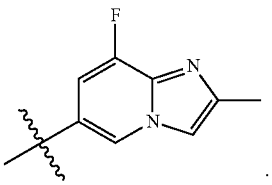.
In some embodiments, B is selected from
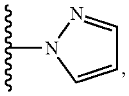,
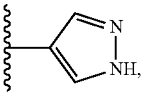
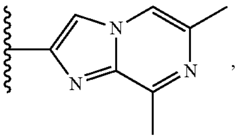,
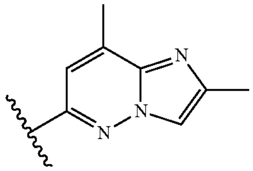,
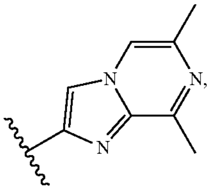
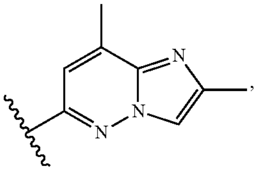,
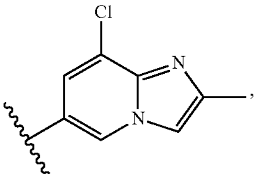,
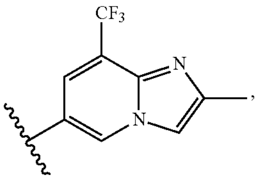, and
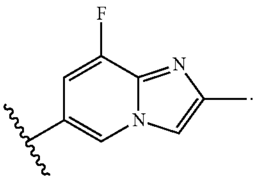.
In some embodiments, B is selected is
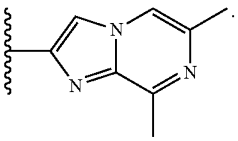 [SMILES: *c1cn2cc(C)nc(C)c2n1].
In some embodiments, B is
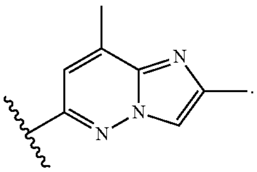 [SMILES: *c1cc(C)c2nc(C)cn2n1].
In some embodiments, B is
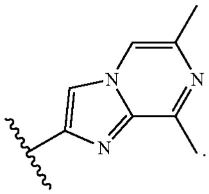 [SMILES: *c1cn2cc(C)nc(C)c2n1].

In some embodiments, B is

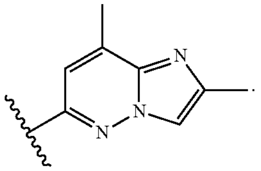 [SMILES: *c1cc(C)c2nc(C)cn2n1]

In some embodiments, B is

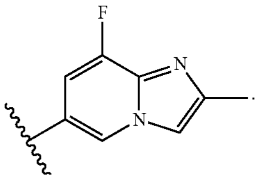 [SMILES: *c1cc(F)c2nc(C)cn2c1]

In some embodiments, the compound of Formula (I) is a compound of Formula (I-d):

(I-d)

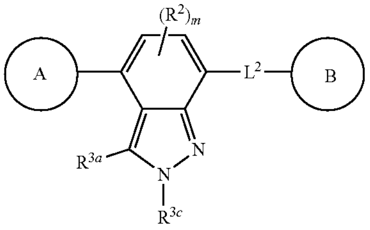

or a pharmaceutically acceptable salt, solvate, hydrate, tautomer, or stereoisomer thereof, wherein:

A and B are each independently cycloalkyl, heterocyclyl, aryl, or heteroaryl, each of which is optionally substituted with one or more $R^1$;

$L^2$ is absent, $C_1$-$C_6$-alkylene, $C_1$-$C_6$-heteroalkylene, —O—, —C(O)—, —N($R^4$)—, —N($R^4$)C(O)—, or —C(O)N($R^4$)—, wherein each alkylene and heteroalkylene is optionally substituted with one or more $R^5$;

each $R^1$ is independently hydrogen, $C_1$-$C_6$-alkyl, $C_2$-$C_6$-alkenyl, $C_2$-$C_6$-alkynyl, $C_1$-$C_6$-heteroalkyl, $C_1$-$C_6$-haloalkyl, cycloalkyl, heterocyclyl, aryl, $C_1$-$C_6$ alkylene-aryl, $C_1$-$C_6$ alkenylene-aryl, $C_1$-$C_6$ alkylene-heteroaryl, heteroaryl, halo, cyano, oxo, —$OR^A$, —$NR^BR^C$, —$NR^BC(O)R^D$, —$NO_2$, —$C(O)NR^BR^C$, —$C(O)R^D$, —$C(O)OR^D$, —$SR^E$, or —$S(O)_xR^D$, wherein each alkyl, alkylene, alkenyl, alkynyl, heteroalkyl, haloalkyl, cycloalkyl, heterocyclyl, aryl, and heteroaryl is optionally substituted with one or more $R^6$; or two $R^1$ groups, together with the atoms to which they are attached, form a 3-7-membered cycloalkyl, heterocyclyl, aryl, or heteroaryl, wherein each cycloalkyl, heterocyclyl, aryl, and heteroaryl is optionally substituted with one or more $R^6$;

each $R^2$ is independently hydrogen, $C_1$-$C_6$-alkyl, $C_2$-$C_6$-alkenyl, $C_2$-$C_6$-alkynyl, $C_1$-$C_6$-heteroalkyl, $C_1$-$C_6$-haloalkyl, halo, cyano, or —$OR^A$;

$R^{3a}$ is hydrogen, $C_1$-$C_6$-alkyl, $C_1$-$C_6$-heteroalkyl, $C_1$-$C_6$-haloalkyl, halo, cyano, —$OR^A$, —$NR^BR^C$, —$C(O)R^D$, or —$C(O)OR^D$;

$R^{3c}$ is hydrogen, $C_1$-$C_6$-alkyl, $C_1$-$C_6$-heteroalkyl, $C_1$-$C_6$-haloalkyl, halo, cyano, or —$C(O)R^D$;

each $R^4$ is independently hydrogen, $C_1$-$C_6$-alkyl, or $C_1$-$C_6$-haloalkyl;

each $R^5$ is independently hydrogen, $C_1$-$C_6$-alkyl, $C_1$-$C_6$-heteroalkyl, $C_1$-$C_6$-haloalkyl, cycloalkyl, halo, cyano, oxo, —$OR^A$, —$NR^BR^C$, —$C(O)R^D$, or —$C(O)OR^D$;

each $R^6$ is independently $C_1$-$C_6$-alkyl, $C_2$-$C_6$-alkenyl, $C_2$-$C_6$-alkynyl, $C_1$-$C_6$-heteroalkyl, $C_1$-$C_6$-haloalkyl, cycloalkyl, heterocyclyl, aryl, heteroaryl, halo, cyano, oxo, —$OR^A$, —$NR^BR^C$, —$NR^BC(O)R^D$, —$NO_2$, —$C(O)NR^BR^C$, —$C(O)R^D$, —$C(O)OR^D$, —$SR^E$, or —$S(O)_xR^D$, wherein each alkyl, alkenyl, alkynyl, heteroalkyl, haloalkyl, cycloalkyl, heterocyclyl, aryl, and heteroaryl is optionally substituted with one or more $R^{11}$;

each $R^7$ is $C_1$-$C_6$-alkyl, halo, cyano, oxo, or —$OR^{A1}$;

each $R^{11}$ is independently $C_1$-$C_6$-alkyl, $C_1$-$C_6$-heteroalkyl, $C_1$-$C_6$-haloalkyl, cycloalkyl, heterocyclyl, aryl, heteroaryl, halo, cyano, oxo, or —$OR^A$;

each $R^A$ is independently hydrogen, $C_1$-$C_6$ alkyl, $C_1$-$C_6$ haloalkyl, aryl, heteroaryl, $C_1$-$C_6$ alkylene-aryl, $C_1$-$C_6$ alkylene-heteroaryl, —$C(O)R^D$, or —$S(O)_xR^D$;

each of $R^B$ and $R^C$ is independently hydrogen, $C_1$-$C_6$ alkyl, $C_1$-$C_6$ heteroalkyl, cycloalkyl, heterocyclyl, or —$OR^A$; or $R^B$ and $R^C$ together with the atom to which they are attached form a 3-7-membered heterocyclyl ring optionally substituted with one or more $R^7$;

each $R^D$ and $R^E$ is independently hydrogen, $C_1$-$C_6$ alkyl, $C_2$-$C_6$ alkenyl, $C_2$-$C_6$ alkynyl, $C_1$-$C_6$ heteroalkyl, $C_1$-$C_6$ haloalkyl, cycloalkyl, heterocyclyl, aryl, heteroaryl, $C_1$-$C_6$ alkylene-aryl, or $C_1$-$C_6$ alkylene-heteroaryl;

each $R^{A1}$ is hydrogen or $C_1$-$C_6$-alkyl;

m is 0, 1, or 2; and x is 0, 1, or 2.

In some embodiments, A is heterocyclyl optionally substituted with one or more $R^1$. In some embodiments, A is bicyclic heterocyclyl. In some embodiments, A is monocyclic nitrogen-containing heterocyclyl. In some embodiments, A is bicyclic nitrogen-containing heterocyclyl. In some embodiments, A is optionally substituted piperidinyl. In some embodiments, A is optionally substituted piperazinyl. In some embodiments, A is

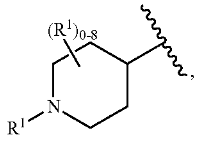

wherein each $R^1$ is independently hydrogen or $C_1$-$C_6$-alkyl. In some embodiments, A is

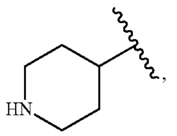 [SMILES: *C1CCNCC1]

In some embodiments, A is

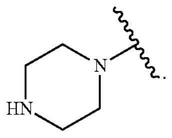 [SMILES: *N1CCNCC1]

In some embodiments, $L^2$ is absent. In some embodiments, $L^2$ is $C_1$-$C_6$-heteroalkylene, that is optionally substituted with one or more $R^5$. In some embodiments, $L^2$ is —C(O)N($R^4$)—. In some embodiments, $L^2$ is —C(O)N(H)—.

In some embodiments, $R^{3a}$ is independently hydrogen or $C_1$-$C_6$-alkyl (e.g., $CH_3$). In some embodiments, $R^{3a}$ is independently hydrogen. In some embodiments, $R^{3a}$ is independently $C_1$-$C_6$-alkyl (e.g., $CH_3$).

In some embodiments, $R^{3c}$ is independently hydrogen or $C_1$-$C_6$-alkyl (e.g., $CH_3$). In some embodiments, $R^{3c}$ is independently hydrogen. In some embodiments, $R^{3c}$ is independently $C_1$-$C_6$-alkyl (e.g., $CH_3$).

In some embodiments, B is heteroaryl optionally substituted with one or more $R^1$. In some embodiments, B is monocyclic heteroaryl. In some embodiments, B is bicyclic heteroaryl. In some embodiments, B is monocyclic nitrogen-containing heteroaryl. In some embodiments, B is bicyclic nitrogen-containing heteroaryl. In some embodiments, B is optionally substituted pyrazolyl. In some embodiments, B is selected from

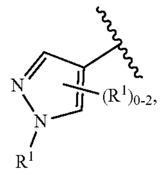 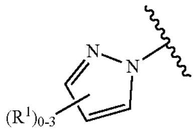, 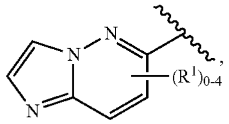, 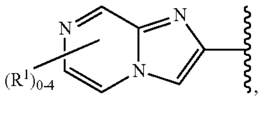, and 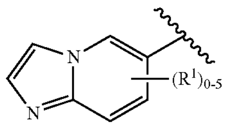

wherein each $R^1$ is as defined above. In some embodiments, B is

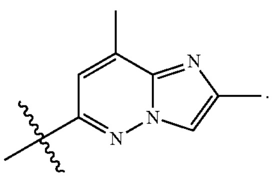 [SMILES: *c1cc(C)c2nc(C)cn2n1]

In some embodiments, B is

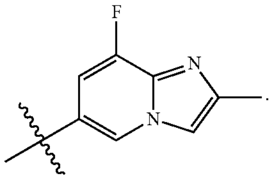 [SMILES: *c1cc(F)c2nc(C)cn2c1]

In some embodiments, A is selected from

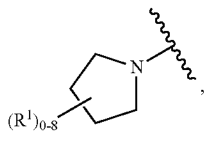, 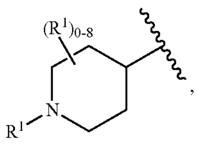, 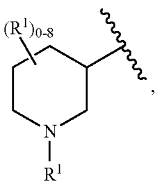, 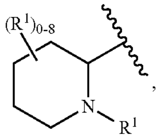, 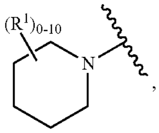, 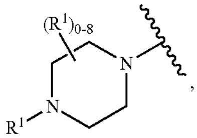, 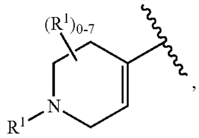, 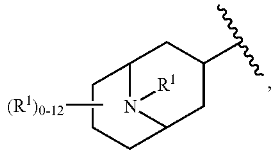, 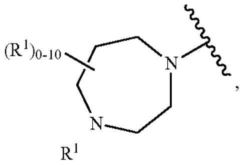, 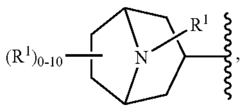, 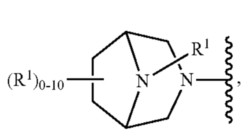, 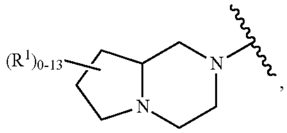, and 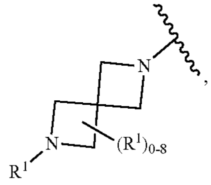, wherein $R^1$ is as defined herein.

In some embodiments, A is selected from

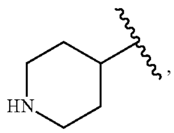, 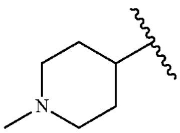, 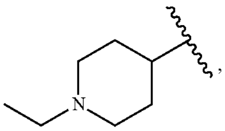, 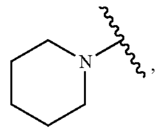,

-continued
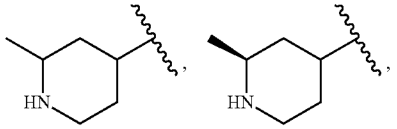
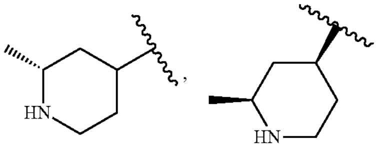
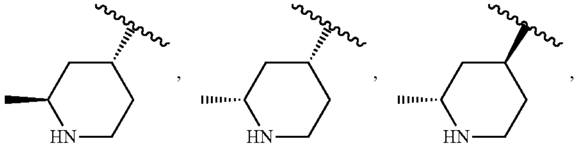
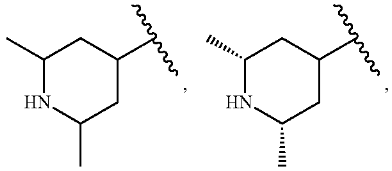
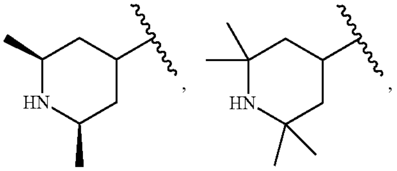
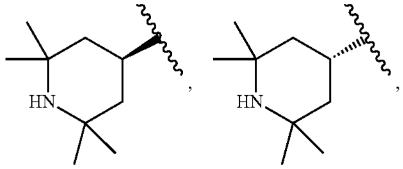
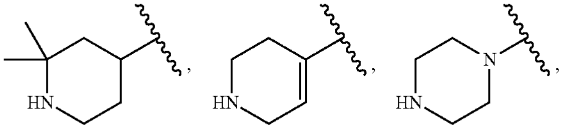
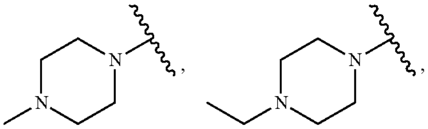
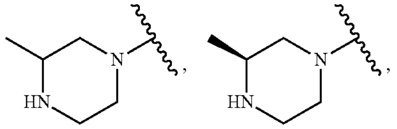
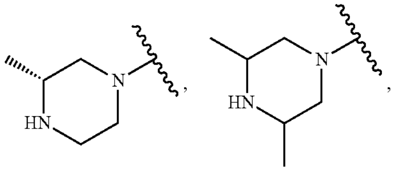
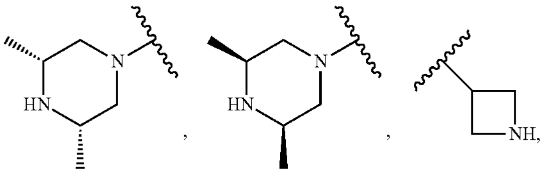
-continued
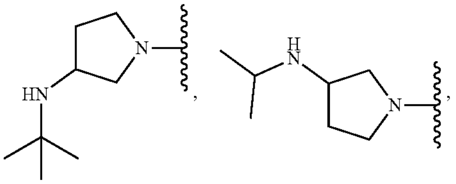
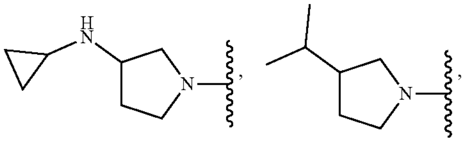
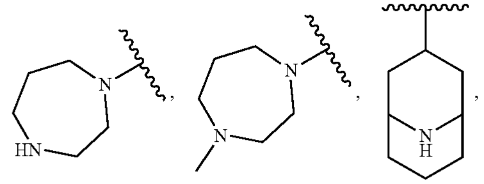
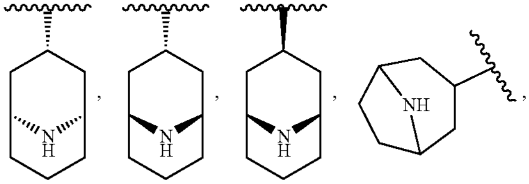
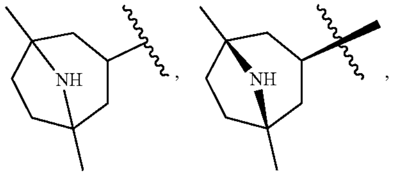
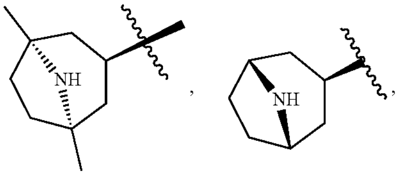
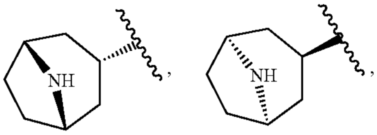
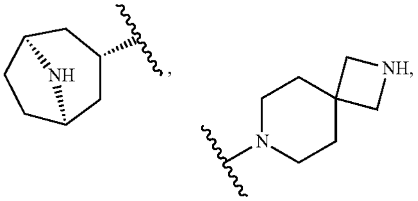
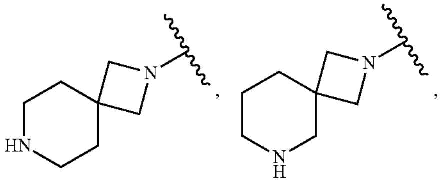
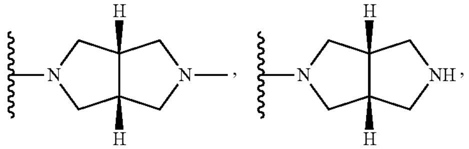

-continued
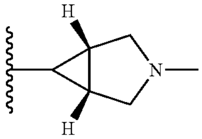, 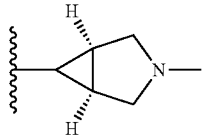,
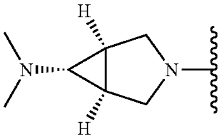, 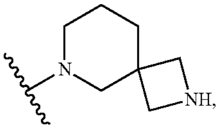,
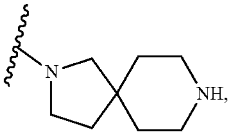, 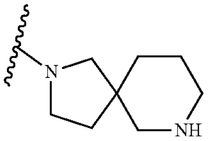,
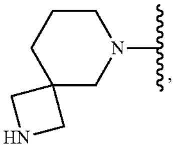, 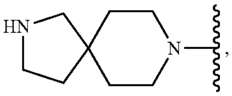,
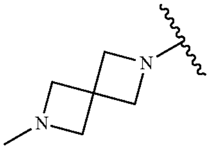, 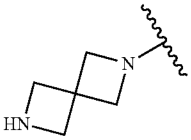, and
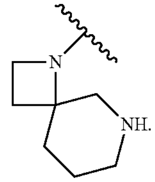.
In some embodiments, A is selected from
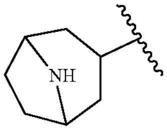, 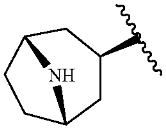, 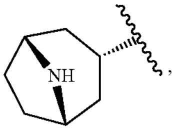,
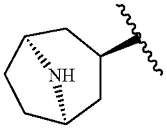, 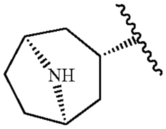, 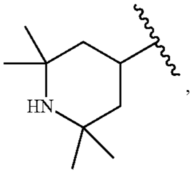,
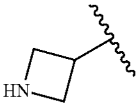, 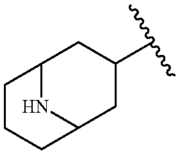, 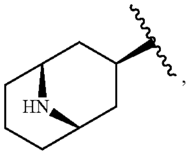,
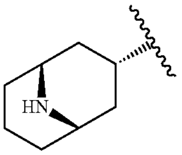, 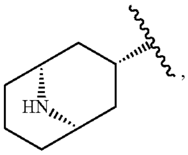,
-continued
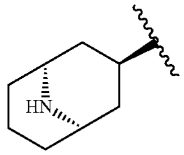, 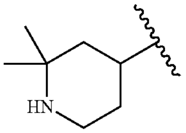,
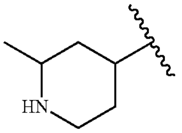, 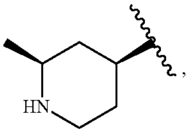,
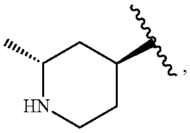, 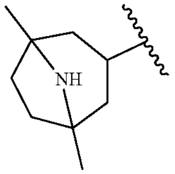,
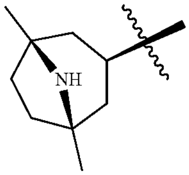, and 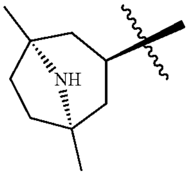.
In some embodiments, A is selected from
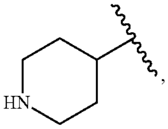, 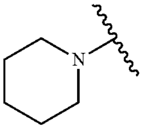, 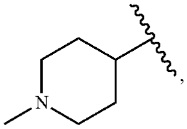,
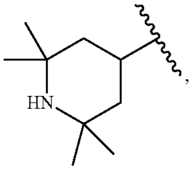, 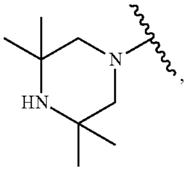,
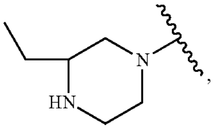, 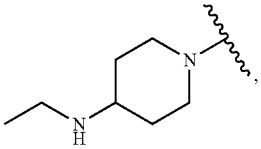,
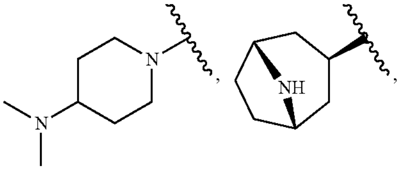,
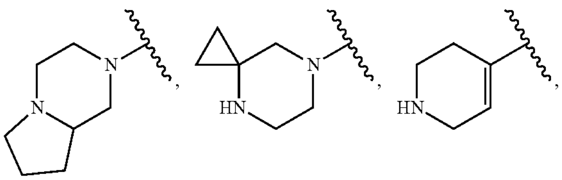,
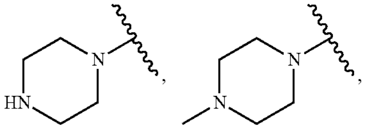, -continued
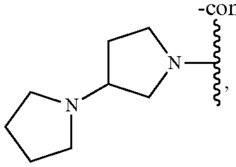
, and
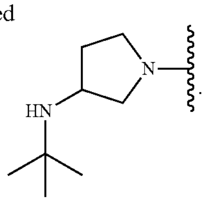
In some embodiments, A is
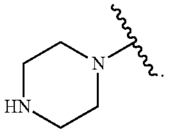
In some embodiments, A is
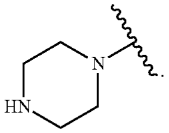 [SMILES: *N1CCNCC1]
In some embodiments, A is
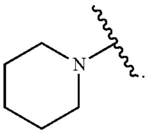 [SMILES: *N1CCCCC1]
In some embodiments, A is
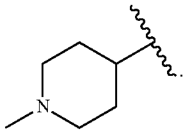
In some embodiments, A is
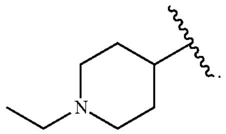 [SMILES: *C1CCN(CC)CC1]
In some embodiments, A is
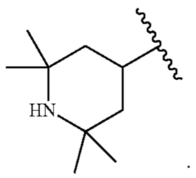 [SMILES: *C1CC(C)(C)NC(C)(C)C1]
In some embodiments, A is
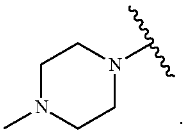 [SMILES: *N1CCN(C)CC1]
In some embodiments, A is
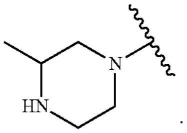
In some embodiments, A is
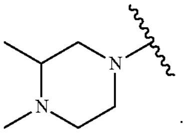 [SMILES: *N1CCN(C)C(C)C1]
In some embodiments, A is
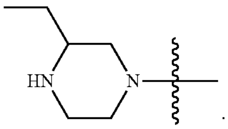 [SMILES: *N1CCNC(CC)C1]
In some embodiments, A is
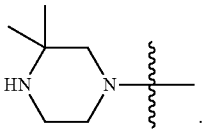 [SMILES: *N1CCNC(C)(C)C1]
In some embodiments, A is
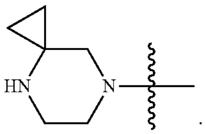
In some embodiments, A is
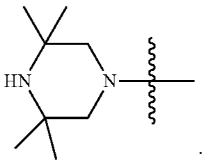 [SMILES: *N1CC(C)(C)NC(C)(C)C1]

In some embodiments, A is
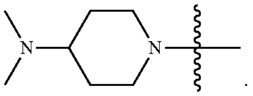 [SMILES: *N1CCC(N(C)C)CC1]
In some embodiments, A is
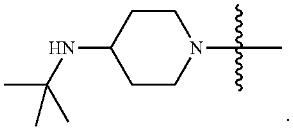 [SMILES: *N1CCC(NC(C)(C)C)CC1]
In some embodiments, A is
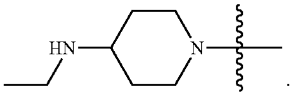 [SMILES: *N1CCC(NCC)CC1]
In some embodiments, A is
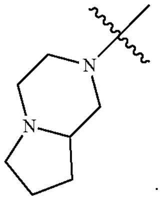 [SMILES: *N1CCN2CCCC2C1]
In some embodiments, A is
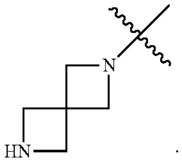 [SMILES: *N1CC2(CNC2)C1]
In some embodiments, A
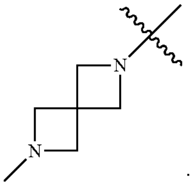 [SMILES: *N1CC2(C1)CN(C)C2]
In some embodiments, A is
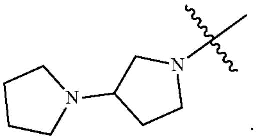 [SMILES: *N1CCC(N2CCCC2)C1]
In some embodiments, A is
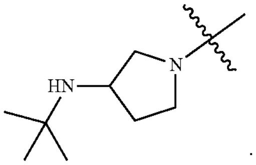 [SMILES: *N1CCC(NC(C)(C)C)C1]
In some embodiments, A is
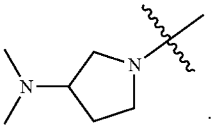 [SMILES: *N1CCC(N(C)C)C1]
In some embodiments, A is
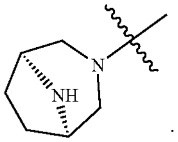 [SMILES: *N1C[C@H]2CC[C@@H](C1)N2]
In some embodiments, A is
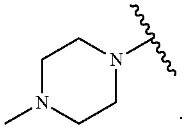 [SMILES: *N1CCN(C)CC1]
In some embodiments, A is
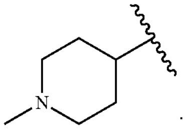 [SMILES: *C1CCN(C)CC1]
In some embodiments, A is
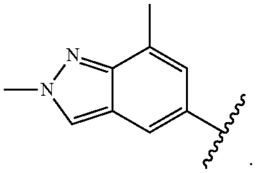 [SMILES: *c1cc(C)c2nn(C)cc2c1]

In some embodiments, A is
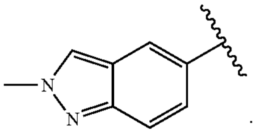 [SMILES: *c1ccc2nn(C)cc2c1].
In some embodiments, B is selected from
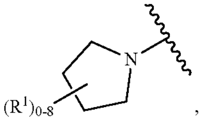, 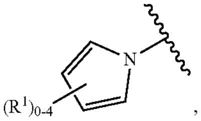,
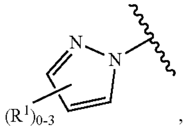, and 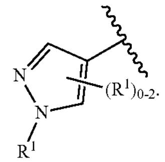.
In some embodiments, B is selected from
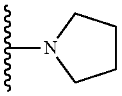, 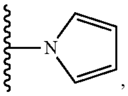, 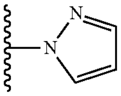, and
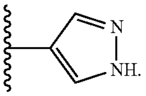
In some embodiments, B is selected from
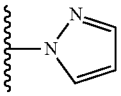, 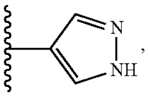, 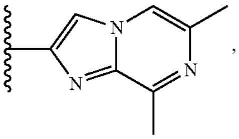,
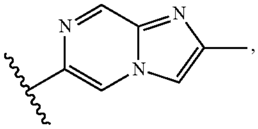, 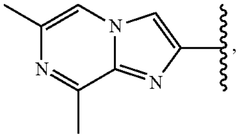,
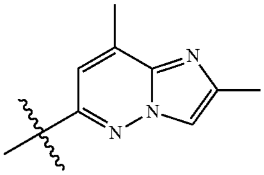, 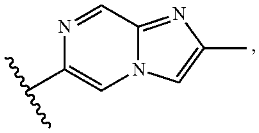,
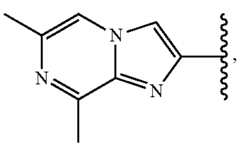, 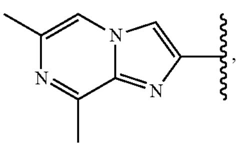,
-continued
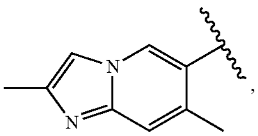, 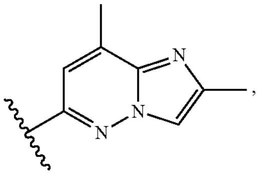,
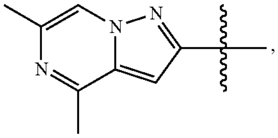, 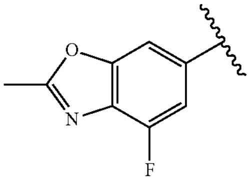
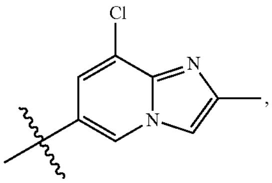, 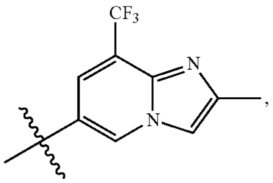,
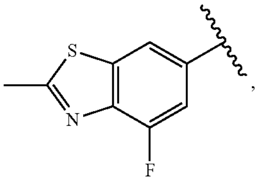, 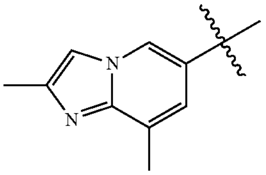,
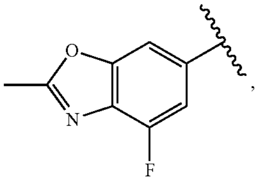, 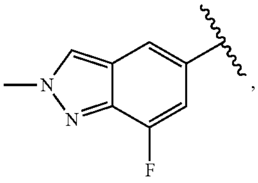,
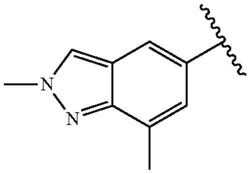, and
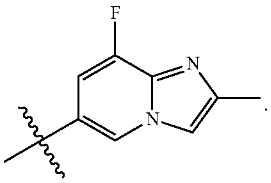.
In some embodiments, B is selected from
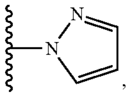, 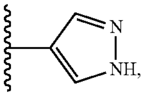, 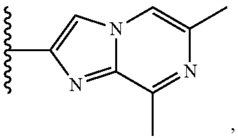 [SMILES: *c1cn2cc(C)nc(C)c2n1], -continued

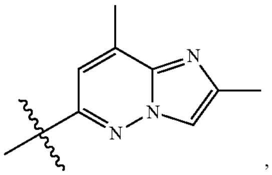

,

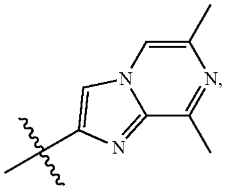

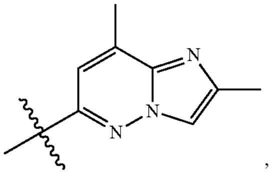 [SMILES: *c1cc(C)c2nc(C)cn2n1]

,

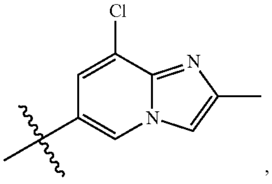

,

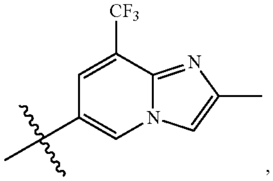

, and

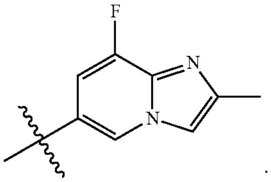

.

In some embodiments, B is selected is

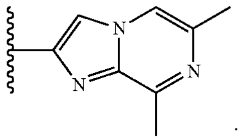

.

In some embodiments, B is

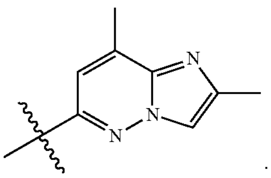

.

In some embodiments, B is

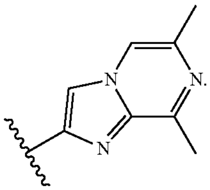 [SMILES: *c1cn2cc(C)nc(C)c2n1]

In some embodiments, B is

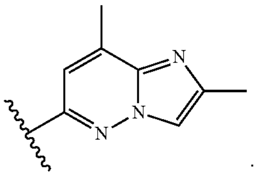 [SMILES: *c1cc(C)c2nc(C)cn2n1]

.

In some embodiments, B is

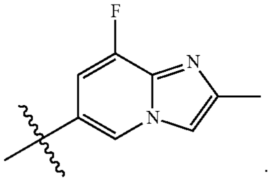 [SMILES: *c1cc(F)c2nc(C)cn2c1]

.

In some embodiments, $R^2$ is $C_1$-$C_6$-alkyl. In some embodiments, $R^2$ is halo (e.g., fluoro). In some embodiments, $R^2$ is —$OR^A$ (e.g., —OH). In some embodiments, $R^{3a}$ is hydrogen. In some embodiments, $R^{3c}$ is hydrogen. In some embodiments, m is 0.

In some embodiments, the compound of Formula (I) is a compound of Formula (I-e):

(I-e)

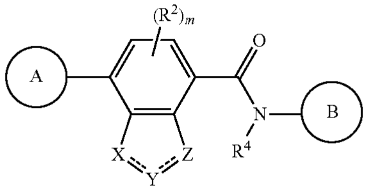

or a pharmaceutically acceptable salt, solvate, hydrate, tautomer, or stereoisomer thereof, wherein:

A and B are each independently cycloalkyl, heterocyclyl, aryl, or heteroaryl, each of which is optionally substituted with one or more $R^1$;

X, Y, and Z are each independently $C(R^{3a})$, $C(R^{3a})(R^{3b})$, N, $N(R^{3c})$, or O, wherein at least one of X, Y, and Z is N, $N(R^{3c})$, or O, and the bonds in the ring comprising X, Y, and Z may be single or double bonds as valency permits;

each $R^1$ is independently hydrogen, $C_1$-$C_6$-alkyl, $C_2$-$C_6$-alkenyl, $C_2$-$C_6$-alkynyl, $C_1$-$C_6$-heteroalkyl, $C_1$-$C_6$-haloalkyl, cycloalkyl, heterocyclyl, aryl, $C_1$-$C_6$ alkylene-aryl, $C_1$-$C_6$ alkenylene-aryl, $C_1$-$C_6$ alkylene-heteroaryl, heteroaryl, halo, cyano, oxo, —$OR^A$, —$NR^BR^C$, —$NR^BC(O)R^D$, —$NO_2$, —$C(O)NR^BR^C$, —$C(O)R^D$, —$C(O)OR^D$, —$SR^E$, or —$S(O)_xR^D$, wherein each alkyl, alkylene, alkenyl, alkynyl, heteroalkyl, haloalkyl, cycloalkyl, heterocyclyl, aryl, and heteroaryl is optionally substituted with one or more $R^6$; or two $R^1$ groups, together with the atoms to which they are attached, form a 3-7-membered cycloalkyl, heterocyclyl, aryl, or heteroaryl, wherein each cycloalkyl, heterocyclyl, aryl, and heteroaryl is optionally substituted with one or more $R^6$;

each $R^2$ is independently hydrogen, $C_1$-$C_6$-alkyl, $C_2$-$C_6$-alkenyl, $C_2$-$C_6$-alkynyl, $C_1$-$C_6$-heteroalkyl, $C_1$-$C_6$-haloalkyl, halo, cyano, or —$OR^A$;

$R^{3a}$ and $R^{3b}$ are each independently hydrogen, $C_1$-$C_6$-alkyl, $C_1$-$C_6$-heteroalkyl, $C_1$-$C_6$-haloalkyl, halo, cyano, —$OR^A$, —$NR^BR^C$, —$C(O)R^D$, or —$C(O)OR^D$; or each of $R^{3a}$ and $R^{3b}$, together with the carbon atom to which they are attached, form an oxo group;

$R^{3c}$ is hydrogen or $C_1$-$C_6$-alkyl;

each $R^4$ is independently hydrogen, $C_1$-$C_6$-alkyl, or $C_1$-$C_6$-haloalkyl;

each $R^6$ is independently $C_1$-$C_6$-alkyl, $C_2$-$C_6$-alkenyl, $C_2$-$C_6$-alkynyl, $C_1$-$C_6$-heteroalkyl, $C_1$-$C_6$-haloalkyl, cycloalkyl, heterocyclyl, aryl, heteroaryl, halo, cyano, oxo, —$OR^A$, —$NR^BR^C$, —$NR^BC(O)R^D$, —$NO_2$, —$C(O)NR^BR^C$, —$C(O)R^D$, —$C(O)OR^D$, —$SR^E$, or —$S(O)_xR^D$, wherein each alkyl, alkenyl, alkynyl, heteroalkyl, haloalkyl, cycloalkyl, heterocyclyl, aryl, and heteroaryl is optionally substituted with one or more $R^1$;

each $R^7$ is $C_1$-$C_6$-alkyl, halo, cyano, oxo, or —$OR^{A1}$;

each $R^{11}$ is independently $C_1$-$C_6$-alkyl, $C_1$-$C_6$-heteroalkyl, $C_1$-$C_6$-haloalkyl, cycloalkyl, heterocyclyl, aryl, heteroaryl, halo, cyano, oxo, or —$OR^A$;

each $R^A$ is independently hydrogen, $C_1$-$C_6$ alkyl, $C_1$-$C_6$ haloalkyl, aryl, heteroaryl, $C_1$-$C_6$ alkylene-aryl, $C_1$-$C_6$ alkylene-heteroaryl, —$C(O)R^D$, or —$S(O)_xR^D$;

each of $R^B$ and $R^C$ is independently hydrogen, $C_1$-$C_6$ alkyl, $C_1$-$C_6$ heteroalkyl, cycloalkyl, heterocyclyl, or —$OR^A$; or $R^B$ and $R^C$ together with the atom to which they are attached form a 3-7-membered heterocyclyl ring optionally substituted with one or more $R^7$;

each $R^D$ and $R^E$ is independently hydrogen, $C_1$-$C_6$ alkyl, $C_2$-$C_6$ alkenyl, $C_2$-$C_6$ alkynyl, $C_1$-$C_6$ heteroalkyl, $C_1$-$C_6$ haloalkyl, cycloalkyl, heterocyclyl, aryl, heteroaryl, $C_1$-$C_6$ alkylene-aryl, or $C_1$-$C_6$ alkylene-heteroaryl;

each $R^{A1}$ is hydrogen or $C_1$-$C_6$-alkyl;

m is 0, 1, or 2; and x is 0, 1, or 2.

In some embodiments, A is selected from

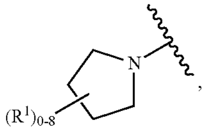,
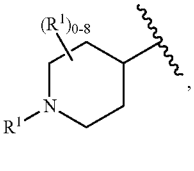,
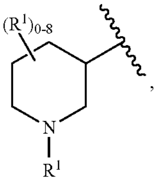,
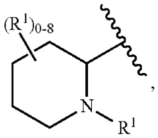,
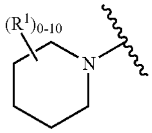,
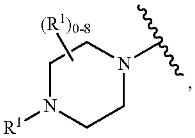,
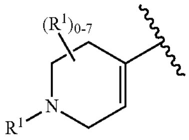,
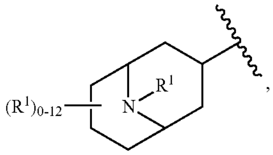,
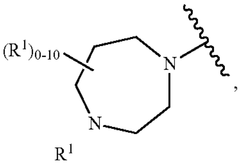,
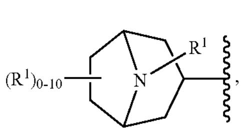, -continued

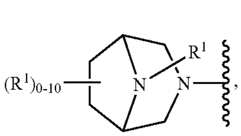,
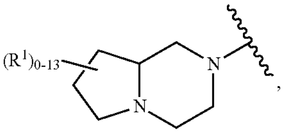, and
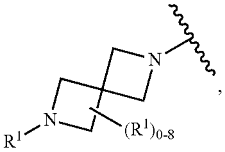, wherein $R^1$ is as defined herein.

In some embodiments, A is selected from

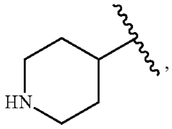,
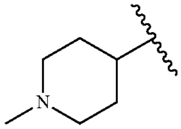,
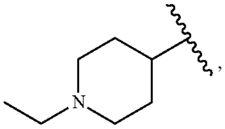,
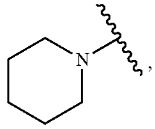,
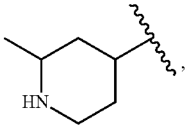,
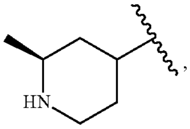,
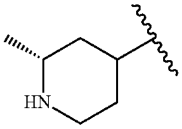,
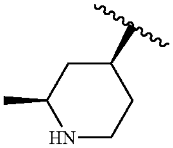,
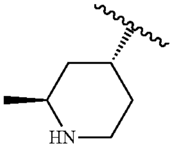,
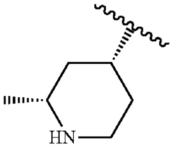,
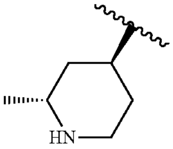,
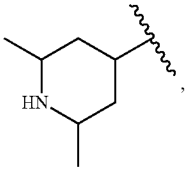,
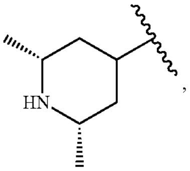,
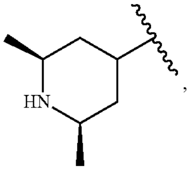,
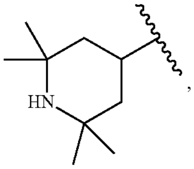,
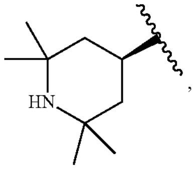,
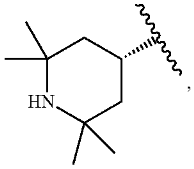, -continued
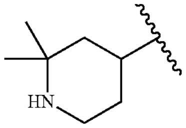, 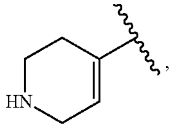, 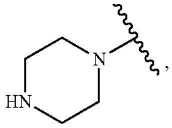,
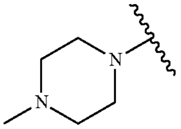, 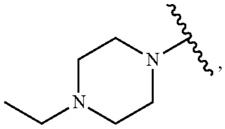,
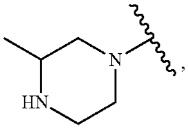, 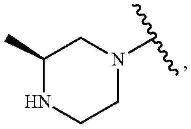,
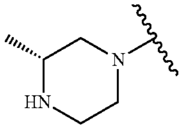, 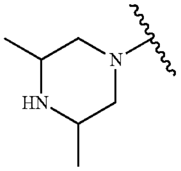,
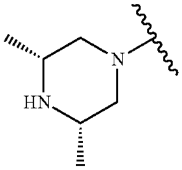, 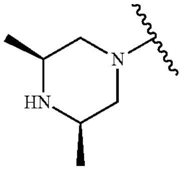, 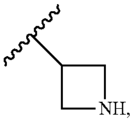,
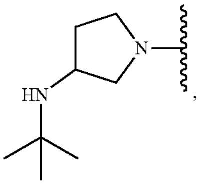, 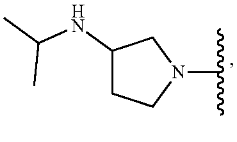,
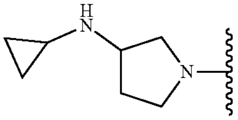, 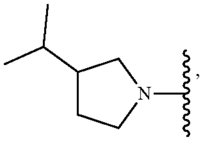,
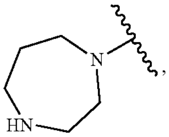, 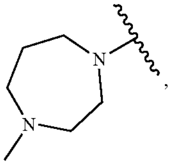, 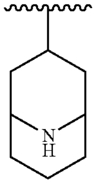,
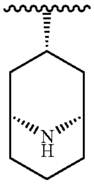, 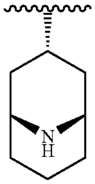, 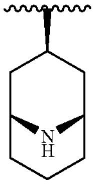, 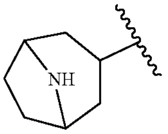,
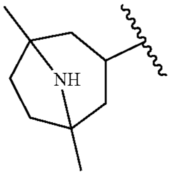, 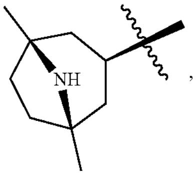,
-continued
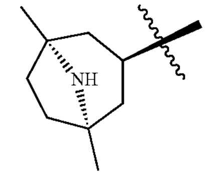, 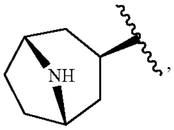,
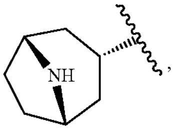, 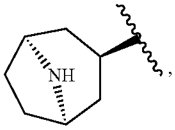,
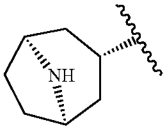, 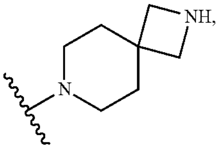,
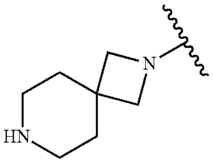, 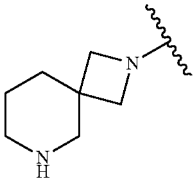,
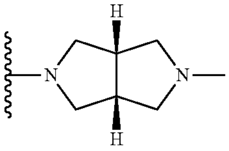, 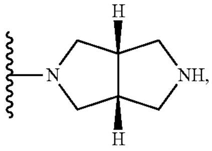,
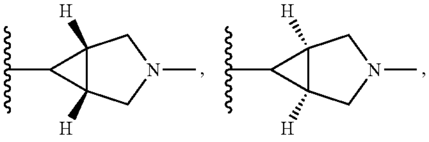,
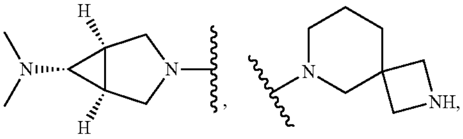,
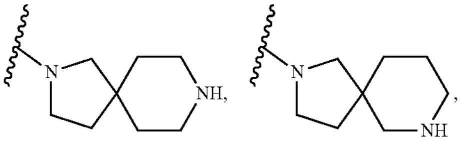,
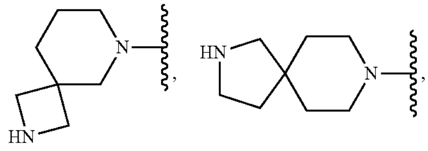,
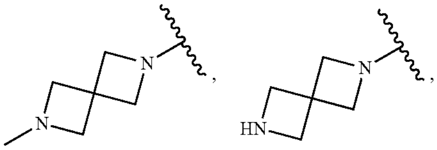, and -continued
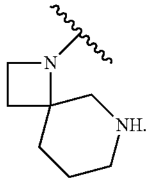
In some embodiments, A is selected from
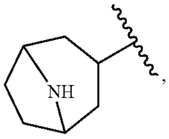, 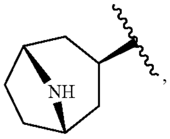, 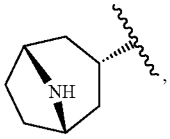,
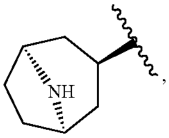, 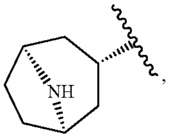, 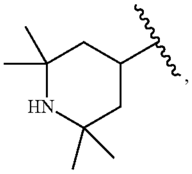,
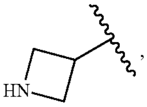, 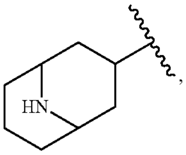, 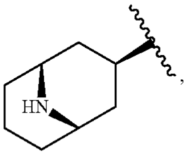,
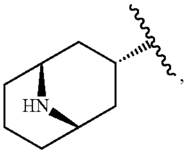, 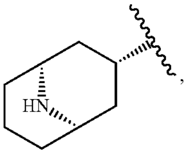, 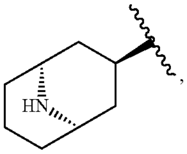,
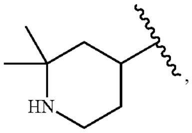, 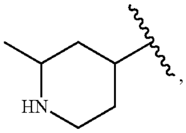, 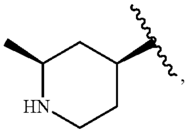,
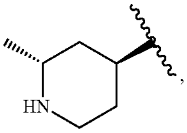, 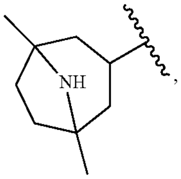,
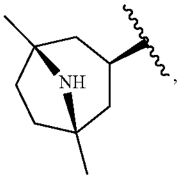, and 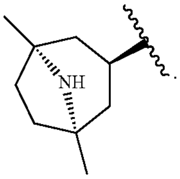.
In some embodiments, A is selected from
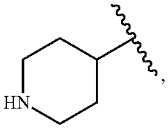, 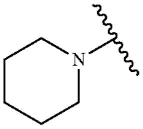, 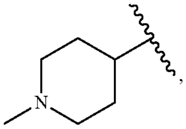,
-continued
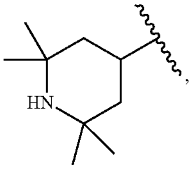, 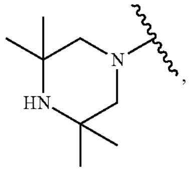,
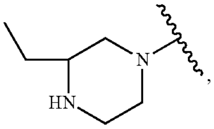, 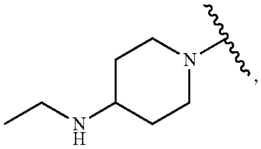,
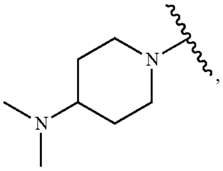, 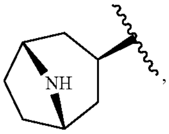,
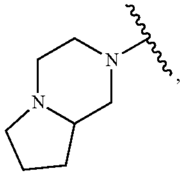, 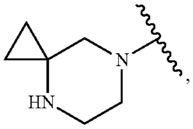, 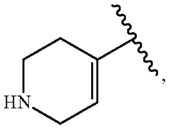,
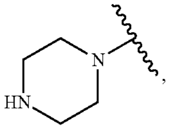, 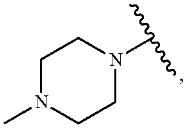,
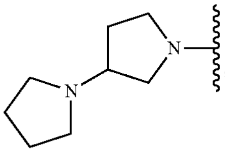, and 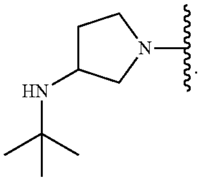.
In some embodiments, A is
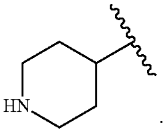.
In some embodiments, A is
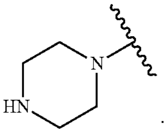.

In some embodiments, A is
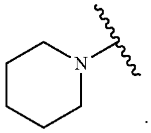 [SMILES: *N1CCCCC1]
.
In some embodiments, A is
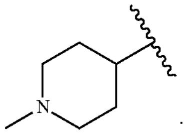 [SMILES: *C1CCN(C)CC1]
.
In some embodiments, A is
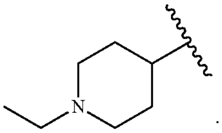 [SMILES: *C1CCN(CC)CC1]
.
In some embodiments, A is
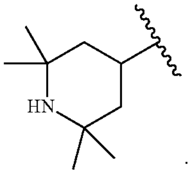 [SMILES: *C1CC(C)(C)NC(C)(C)C1]
.
In some embodiments, A is
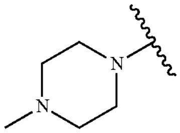
.
In some embodiments, A is
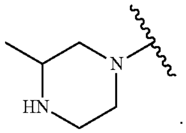 [SMILES: *N1CCNC(C)C1]
.
In some embodiments, A is
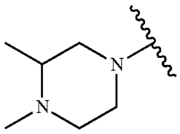
.
In some embodiments, A is
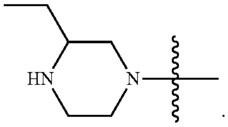 [SMILES: *N1CCNC(CC)C1]
.
In some embodiments, A is
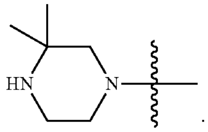 [SMILES: *N1CCNC(C)(C)C1]
.
In some embodiments, A is
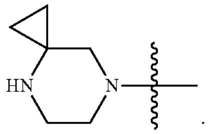 [SMILES: *N1CCNC2(CC2)C1]
.
In some embodiments, A is
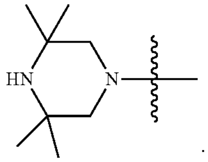 [SMILES: *N1CC(C)(C)NC(C)(C)C1]
.
In some embodiments, A is
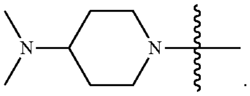 [SMILES: *N1CCC(N(C)C)CC1]
.
In some embodiments, A is
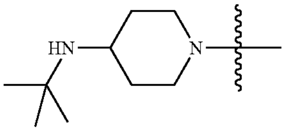
.
In some embodiments, A is
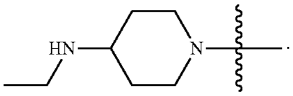 [SMILES: *N1CCC(NCC)CC1]
.

In some embodiments, A is

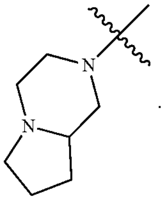 [SMILES: *N1CCN2CCCC2C1]

In some embodiments, A is

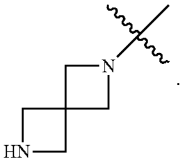

In some embodiments, A is

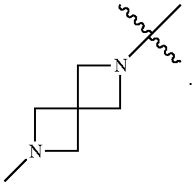 [SMILES: *N1CC2(C1)CN(C)C2]

In some embodiments, A is

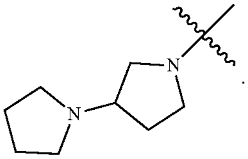 [SMILES: *N1CCC(N2CCCC2)C1]

In some embodiments, A is

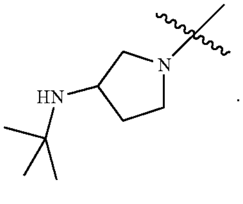 [SMILES: *N1CCC(NC(C)(C)C)C1]

In some embodiments, A is

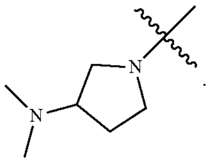 [SMILES: *N1CCC(N(C)C)C1]

In some embodiments, A is

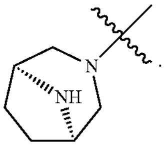 [SMILES: *N1C[C@H]2CC[C@@H](C1)N2]

In some embodiments, A is

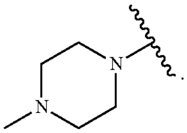 [SMILES: *N1CCN(C)CC1]

In some embodiments, A is

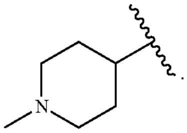 [SMILES: *C1CCN(C)CC1]

In some embodiments, A is

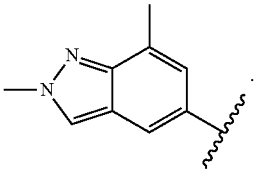 [SMILES: *c1cc(C)c2nn(C)cc2c1]

In some embodiments, A is

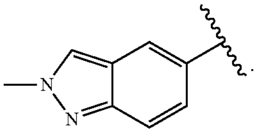

In some embodiments, X is N. In some embodiments, X is O. In some embodiments, X is C($R^{3a}$). In some embodiments, Y is N. In some embodiments, Y is C($R^{3a}$). In some embodiments, Z is C($R^{3a}$) (e.g., CH). In some embodiments, Z is N. In some embodiments, Z is O. In some embodiments, X and Y are each independently N or N($R^{3c}$), and Z is C($R^{3a}$) (e.g., CH). In some embodiments, Y and Z are each independently N or N($R^{3c}$), and X is C($R^{3a}$) (e.g., CH). In some embodiments, X is C($R^{3a}$), Y is C($R^{3a}$), and Z is O. In some embodiments, Y is C($R^{3a}$), Z is C($R^{3a}$), and X is O.

In some embodiments, B is selected from
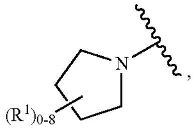, 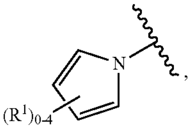, 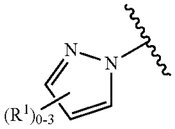, and 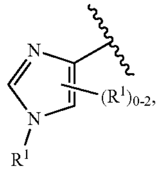
In some embodiments, B is selected from
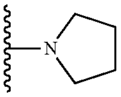, 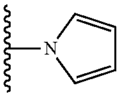, 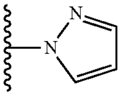, and 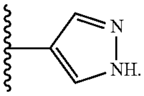
In some embodiments, B is selected from
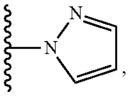, 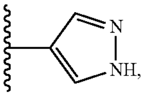 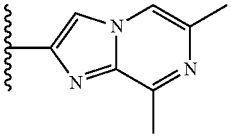, 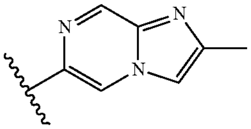, 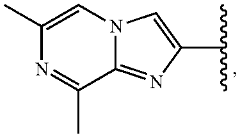 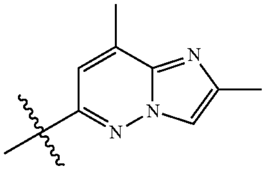, 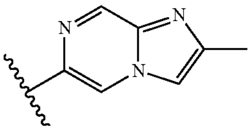, 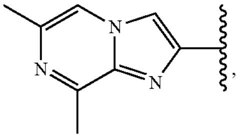 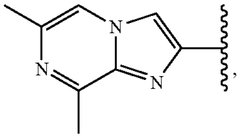 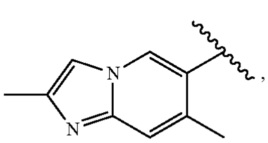, 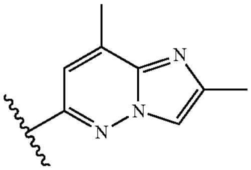, 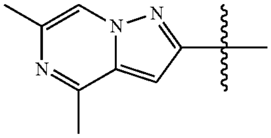, 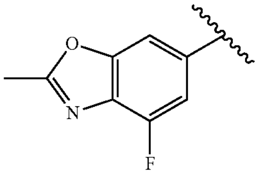,
-continued
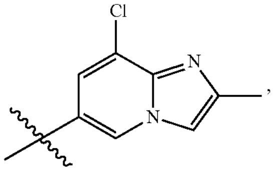, 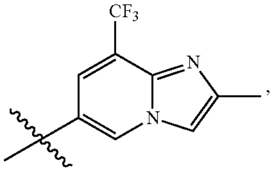, 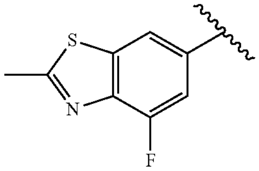, 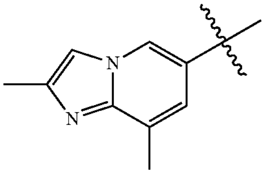, 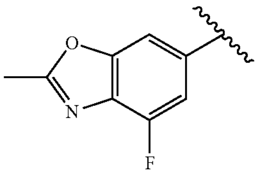, 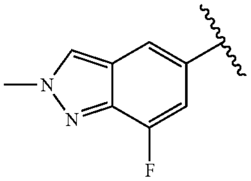, 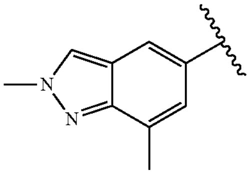, and 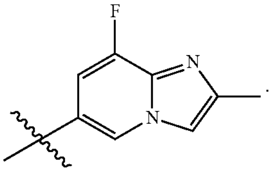.
In some embodiments, B is selected from
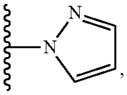, 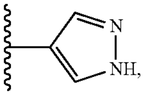 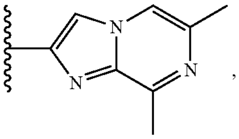, 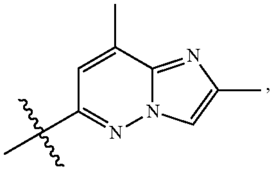, 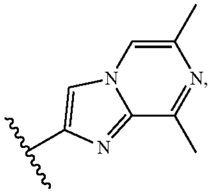 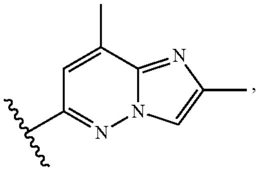, 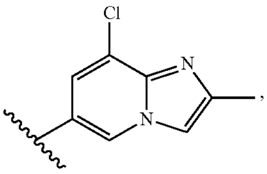, 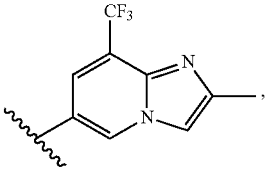, and -continued

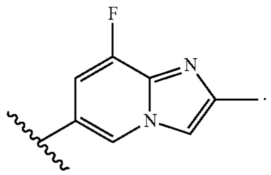

In some embodiments, B is selected is

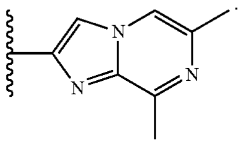 [SMILES: *c1cn2cc(C)nc(C)c2n1]

In some embodiments, B is

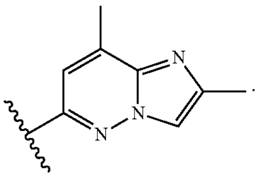 [SMILES: *c1cc(C)c2nc(C)cn2n1]

In some embodiments, B is

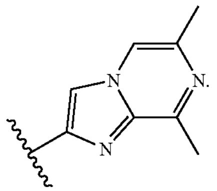 [SMILES: *c1cn2cc(C)nc(C)c2n1]

In some embodiments, B is

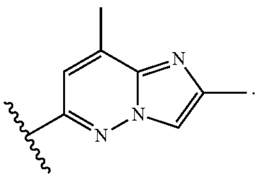 [SMILES: *c1cc(C)c2nc(C)cn2n1]

In some embodiments, B is

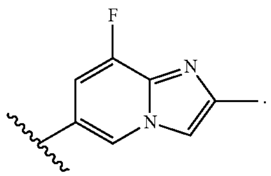 [SMILES: *c1cc(F)c2nc(C)cn2c1]

In some embodiments, the compound of Formula (I) is a compound of Formula (I-f):

(I-f)

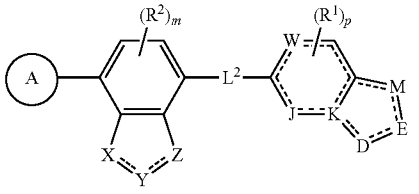

or a pharmaceutically acceptable salt, solvate, hydrate, tautomer, or stereoisomer thereof, wherein:

A and B are each independently cycloalkyl, heterocyclyl, aryl, or heteroaryl, each of which is optionally substituted with one or more $R^1$;

X, Y, and Z are each independently $C(R^{3a})$, $C(R^{3a})(R^{3b})$, N, $N(R^{3c})$, or O, wherein at least one of X, Y, and Z is N, $N(R^{3c})$, or O, and the bonds in the ring comprising X, Y, and Z may be single or double bonds as valency permits;

$L^2$ is absent, $C_1$-$C_6$-alkylene, $C_1$-$C_6$-heteroalkylene, —O—, —C(O)—, —$N(R^4)$—, —$N(R^4)C(O)$—, or —$C(O)N(R^4)$—, wherein each alkylene and heteroalkylene is optionally substituted with one or more $R^5$;

D, E, J, K, M, and W are each independently N and C(R'), wherein at least one of D, E, J, K, M, and W is N; and the bonds in the rings comprising D, E, J, K, M, and W may be single or double bonds as valency permits;

each $R^1$ is independently hydrogen, $C_1$-$C_6$-alkyl, $C_2$-$C_6$-alkenyl, $C_2$-$C_6$-alkynyl, $C_1$-$C_6$-heteroalkyl, $C_1$-$C_6$-haloalkyl, cycloalkyl, heterocyclyl, aryl, $C_1$-$C_6$ alkylene-aryl, $C_1$-$C_6$ alkenylene-aryl, $C_1$-$C_6$ alkylene-heteroaryl, heteroaryl, halo, cyano, oxo, —$OR^A$, —$NR^BR^C$, —$NR^BC(O)R^D$, —$NO_2$, —$C(O)NR^BR^C$, —$C(O)R^D$, —$C(O)OR^D$, —$SR^E$, or —$S(O)_xR^D$, wherein each alkyl, alkylene, alkenyl, alkynyl, heteroalkyl, haloalkyl, cycloalkyl, heterocyclyl, aryl, and heteroaryl is optionally substituted with one or more $R^6$; or two $R^1$ groups, together with the atoms to which they are attached, form a 3-7-membered cycloalkyl, heterocyclyl, aryl, or heteroaryl, wherein each cycloalkyl, heterocyclyl, aryl, and heteroaryl is optionally substituted with one or more $R^6$;

R' is hydrogen, $C_1$-$C_6$-alkyl, or halo;

each $R^2$ is independently hydrogen, $C_1$-$C_6$-alkyl, $C_2$-$C_6$-alkenyl, $C_2$-$C_6$-alkynyl, $C_1$-$C_6$-heteroalkyl, $C_1$-$C_6$-haloalkyl, halo, cyano, or —$OR^A$;

$R^{3a}$ and $R^{3b}$ are each independently hydrogen, $C_1$-$C_6$-alkyl, $C_1$-$C_6$-heteroalkyl, $C_1$-$C_6$-haloalkyl, halo, cyano, —$OR^A$, —$NR^BR^C$, —$C(O)R^D$, or —$C(O)OR^D$; or each of $R^{3a}$ and $R^{3b}$, together with the carbon atom to which they are attached, form an oxo group;

$R^{3c}$ is hydrogen or $C_1$-$C_6$-alkyl;

each $R^4$ is independently hydrogen, $C_1$-$C_6$-alkyl, or $C_1$-$C_6$-haloalkyl;

each $R^5$ is independently hydrogen, $C_1$-$C_6$-alkyl, $C_1$-$C_6$-heteroalkyl, $C_1$-$C_6$-haloalkyl, cycloalkyl, halo, cyano, oxo, —$OR^A$, —$NR^BR^C$, —$C(O)R^D$, or —$C(O)OR^D$;

each $R^6$ is independently $C_1$-$C_6$-alkyl, $C_2$-$C_6$-alkenyl, $C_2$-$C_6$-alkynyl, $C_1$-$C_6$-heteroalkyl, $C_1$-$C_6$-haloalkyl, cycloalkyl, heterocyclyl, aryl, heteroaryl, halo, cyano, oxo, —$OR^A$, —$NR^BR^C$, —$NR^BC(O)R^D$, —$NO_2$, —$C(O)NR^BR^C$, —$C(O)R^D$, —$C(O)OR^D$, —$SR^E$, or —$S(O)_xR^D$, wherein each alkyl, alkenyl, alkynyl, heteroalkyl, haloalkyl, cycloalkyl, heterocyclyl, aryl, and heteroaryl is optionally substituted with one or more $R^{11}$;

each $R^7$ is $C_1$-$C_6$-alkyl, halo, cyano, oxo, or —$OR^{A1}$;

each $R^{11}$ is independently $C_1$-$C_6$-alkyl, $C_1$-$C_6$-heteroalkyl, $C_1$-$C_6$-haloalkyl, cycloalkyl, heterocyclyl, aryl, heteroaryl, halo, cyano, oxo, or —$OR^A$;

each $R^A$ is independently hydrogen, $C_1$-$C_6$ alkyl, $C_1$-$C_6$ haloalkyl, aryl, heteroaryl, $C_1$-$C_6$ alkylene-aryl, $C_1$-$C_6$ alkylene-heteroaryl, —$C(O)R^D$, or —$S(O)_xR^D$;

each of $R^B$ and $R^C$ is independently hydrogen, $C_1$-$C_6$ alkyl, $C_1$-$C_6$ heteroalkyl, cycloalkyl, heterocyclyl, or —$OR^A$; or $R^B$ and $R^C$ together with the atom to which they are attached form a 3-7-membered heterocyclyl ring optionally substituted with one or more $R^7$;

each $R^D$ and $R^E$ is independently hydrogen, $C_1$-$C_6$ alkyl, $C_2$-$C_6$ alkenyl, $C_2$-$C_6$ alkynyl, $C_1$-$C_6$ heteroalkyl, $C_1$-$C_6$ haloalkyl, cycloalkyl, heterocyclyl, aryl, heteroaryl, $C_1$-$C_6$ alkylene-aryl, or $C_1$-$C_6$ alkylene-heteroaryl;

each $R^{A1}$ is hydrogen or $C_1$-$C_6$-alkyl;

m is 0, 1, or 2;

p is 0, 1, 2, 3, or 4; and x is 0, 1, or 2.

In some embodiments, the compound of Formula (I) is a compound of Formula (I-g):

(I-g)

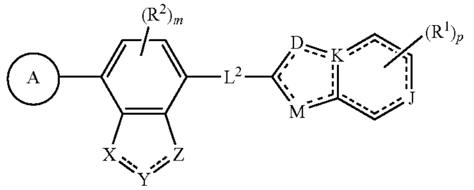

or a pharmaceutically acceptable salt, solvate, hydrate, tautomer, or stereoisomer thereof, wherein:

A and B are each independently cycloalkyl, heterocyclyl, aryl, or heteroaryl, each of which is optionally substituted with one or more $R^1$;

X, Y, and Z are each independently $C(R^{3a})$, $C(R^{3a})(R^{3b})$, N, $N(R^{3c})$, or O, wherein at least one of X, Y, and Z is N, $N(R^{3c})$, or O, and the bonds in the ring comprising X, Y, and Z may be single or double bonds as valency permits;

$L^2$ is absent, $C_1$-$C_6$-alkylene, $C_1$-$C_6$-heteroalkylene, —O—, —C(O)—, —$N(R^4)$—, —$N(R^4)C(O)$—, or —$C(O)N(R^4)$—, wherein each alkylene and heteroalkylene is optionally substituted with one or more $R^5$;

D, J, K, and M are each independently N and C(R'), wherein at least one of D, J, K, and M is N; and the bonds in the rings comprising D, E, J, K, M, and W may be single or double bonds as valency permits;

each $R^1$ is independently hydrogen, $C_1$-$C_6$-alkyl, $C_2$-$C_6$-alkenyl, $C_2$-$C_6$-alkynyl, $C_1$-$C_6$-heteroalkyl, $C_1$-$C_6$-haloalkyl, cycloalkyl, heterocyclyl, aryl, $C_1$-$C_6$ alkylene-aryl, $C_1$-$C_6$ alkenylene-aryl, $C_1$-$C_6$ alkylene-heteroaryl, heteroaryl, halo, cyano, oxo, —$OR^A$, —$NR^BR^C$, —$NR^BC(O)R^D$, —$NO_2$, —$C(O)NR^BR^C$, —$C(O)R^D$, —$C(O)OR^D$, —$SR^E$, or —$S(O)_xR^D$, wherein each alkyl, alkylene, alkenyl, alkynyl, heteroalkyl, haloalkyl, cycloalkyl, heterocyclyl, aryl, and heteroaryl is optionally substituted with one or more $R^6$; or two $R^1$ groups, together with the atoms to which they are attached, form a 3-7-membered cycloalkyl, heterocyclyl, aryl, or heteroaryl, wherein each cycloalkyl, heterocyclyl, aryl, and heteroaryl is optionally substituted with one or more $R^6$;

R' is hydrogen, $C_1$-$C_6$-alkyl, or halo;

each $R^2$ is independently hydrogen, $C_1$-$C_6$-alkyl, $C_2$-$C_6$-alkenyl, $C_2$-$C_6$-alkynyl, $C_1$-$C_6$-heteroalkyl, $C_1$-$C_6$-haloalkyl, halo, cyano, or —$OR^A$;

$R^{3a}$ and $R^{3b}$ are each independently hydrogen, $C_1$-$C_6$-alkyl, $C_1$-$C_6$-heteroalkyl, $C_1$-$C_6$-haloalkyl, halo, cyano, —$OR^A$, —$NR^BR^C$, —$C(O)R^D$, or —$C(O)OR^D$; or each of $R^{3a}$ and $R^{3b}$, together with the carbon atom to which they are attached, form an oxo group;

$R^{3c}$ is hydrogen or $C_1$-$C_6$-alkyl;

each $R^4$ is independently hydrogen, $C_1$-$C_6$-alkyl, or $C_1$-$C_6$-haloalkyl;

each $R^5$ is independently hydrogen, $C_1$-$C_6$-alkyl, $C_1$-$C_6$-heteroalkyl, $C_1$-$C_6$-haloalkyl, cycloalkyl, halo, cyano, oxo, —$OR^A$, —$NR^BR^C$, —$C(O)R^D$, or —$C(O)OR^D$;

each $R^6$ is independently $C_1$-$C_6$-alkyl, $C_2$-$C_6$-alkenyl, $C_2$-$C_6$-alkynyl, $C_1$-$C_6$-heteroalkyl, $C_1$-$C_6$-haloalkyl, cycloalkyl, heterocyclyl, aryl, heteroaryl, halo, cyano, oxo, —$OR^A$, —$NR^BR^C$, —$NR^BC(O)R^D$, —$NO_2$, —$C(O)NR^BR^C$, —$C(O)R^D$, —$C(O)OR^D$, —$SR^E$, or —$S(O)_xR^D$, wherein each alkyl, alkenyl, alkynyl, heteroalkyl, haloalkyl, cycloalkyl, heterocyclyl, aryl, and heteroaryl is optionally substituted with one or more $R^{11}$;

each $R^7$ is $C_1$-$C_6$-alkyl, halo, cyano, oxo, or —$OR^{A1}$;

each $R^{11}$ is independently $C_1$-$C_6$-alkyl, $C_1$-$C_6$-heteroalkyl, $C_1$-$C_6$-haloalkyl, cycloalkyl, heterocyclyl, aryl, heteroaryl, halo, cyano, oxo, or —$OR^A$;

each $R^A$ is independently hydrogen, $C_1$-$C_6$ alkyl, $C_1$-$C_6$ haloalkyl, aryl, heteroaryl, $C_1$-$C_6$ alkylene-aryl, $C_1$-$C_6$ alkylene-heteroaryl, —$C(O)R^D$, or —$S(O)_xR^D$;

each of $R^B$ and $R^C$ is independently hydrogen, $C_1$-$C_6$ alkyl, $C_1$-$C_6$ heteroalkyl, cycloalkyl, heterocyclyl, or —$OR^A$; or $R^B$ and $R^C$ together with the atom to which they are attached form a 3-7-membered heterocyclyl ring optionally substituted with one or more $R^7$;

each $R^D$ and $R^E$ is independently hydrogen, $C_1$-$C_6$ alkyl, $C_2$-$C_6$ alkenyl, $C_2$-$C_6$ alkynyl, $C_1$-$C_6$ heteroalkyl, $C_1$-$C_6$ haloalkyl, cycloalkyl, heterocyclyl, aryl, heteroaryl, $C_1$-$C_6$ alkylene-aryl, or $C_1$-$C_6$ alkylene-heteroaryl;

each $R^{A1}$ is hydrogen or $C_1$-$C_6$-alkyl;

m is 0, 1, or 2;

p is 0, 1, 2, 3, or 4; and x is 0, 1, or 2.

In some embodiments, the compound of Formula (I) is a compound of Formula (I-h):

(I-h)

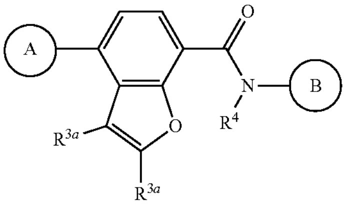

or a pharmaceutically acceptable salt, solvate, hydrate, tautomer, or stereoisomer thereof, wherein:

A and B are each independently cycloalkyl, heterocyclyl, aryl, or heteroaryl, each of which is optionally substituted with one or more $R^1$;

each $R^1$ is independently hydrogen, $C_1$-$C_6$-alkyl, $C_2$-$C_6$-alkenyl, $C_2$-$C_6$-alkynyl, $C_1$-$C_6$-heteroalkyl, $C_1$-$C_6$-haloalkyl, cycloalkyl, heterocyclyl, aryl, $C_1$-$C_6$ alkylene-aryl, $C_1$-$C_6$ alkenylene-aryl, $C_1$-$C_6$ alkylene-heteroaryl, heteroaryl, halo, cyano, oxo, —$OR^A$, —$NR^BR^C$, —$NR^BC(O)R^D$, —$NO_2$, —$C(O)NR^BR^C$, —$C(O)R^D$, —$C(O)OR^D$, —$SR^E$, or —$S(O)_xR^D$, wherein each alkyl, alkylene, alkenyl, alkynyl, heteroalkyl, haloalkyl, cycloalkyl, heterocyclyl, aryl, and heteroaryl is optionally substituted with one or more $R^6$; or two $R^1$ groups, together with the atoms to which they are attached, form a 3-7-membered cycloalkyl, heterocyclyl, aryl, or heteroaryl, wherein each cycloalkyl, heterocyclyl, aryl, and heteroaryl is optionally substituted with one or more $R^6$;

each $R^2$ is independently hydrogen, $C_1$-$C_6$-alkyl, $C_2$-$C_6$-alkenyl, $C_2$-$C_6$-alkynyl, $C_1$-$C_6$-heteroalkyl, $C_1$-$C_6$-haloalkyl, halo, cyano, or —$OR^A$;

each $R^{3a}$ is independently hydrogen, $C_1$-$C_6$-alkyl, $C_1$-$C_6$-heteroalkyl, $C_1$-$C_6$-haloalkyl, halo, cyano, —$OR^A$, —$NR^BR^C$, —$C(O)R^D$, or —$C(O)OR^D$;

each $R^4$ is independently hydrogen, $C_1$-$C_6$-alkyl, or $C_1$-$C_6$-haloalkyl;

each $R^6$ is independently $C_1$-$C_6$-alkyl, $C_2$-$C_6$-alkenyl, $C_2$-$C_6$-alkynyl, $C_1$-$C_6$-heteroalkyl, $C_1$-$C_6$-haloalkyl, cycloalkyl, heterocyclyl, aryl, heteroaryl, halo, cyano, oxo, —$OR^A$, —$NR^BR^C$, —$NR^BC(O)R^D$, —$NO_2$, —$C(O)NR^BR^C$, —$C(O)R^D$, —$C(O)OR^D$, —$SR^E$, or —$S(O)_xR^D$, wherein each alkyl, alkenyl, alkynyl, heteroalkyl, haloalkyl, cycloalkyl, heterocyclyl, aryl, and heteroaryl is optionally substituted with one or more $R^1$;

each $R^7$ is $C_1$-$C_6$-alkyl, halo, cyano, oxo, or —$OR^{A1}$;

each $R^{11}$ is independently $C_1$-$C_6$-alkyl, $C_1$-$C_6$-heteroalkyl, $C_1$-$C_6$-haloalkyl, cycloalkyl, heterocyclyl, aryl, heteroaryl, halo, cyano, oxo, or —$OR^A$;

each $R^A$ is independently hydrogen, $C_1$-$C_6$ alkyl, $C_1$-$C_6$ haloalkyl, aryl, heteroaryl, $C_1$-$C_6$ alkylene-aryl, $C_1$-$C_6$ alkylene-heteroaryl, —$C(O)R^D$, or —$S(O)_xR^D$;

each of $R^B$ and $R^C$ is independently hydrogen, $C_1$-$C_6$ alkyl, $C_1$-$C_6$ heteroalkyl, cycloalkyl, heterocyclyl, or —$OR^A$; or $R^B$ and $R^C$ together with the atom to which they are attached form a 3-7-membered heterocyclyl ring optionally substituted with one or more $R^7$;

each $R^D$ and $R^E$ is independently hydrogen, $C_1$-$C_6$ alkyl, $C_2$-$C_6$ alkenyl, $C_2$-$C_6$ alkynyl, $C_1$-$C_6$ heteroalkyl, $C_1$-$C_6$ haloalkyl, cycloalkyl, heterocyclyl, aryl, heteroaryl, $C_1$-$C_6$ alkylene-aryl, or $C_1$-$C_6$ alkylene-heteroaryl;

each $R^{A1}$ is hydrogen or $C_1$-$C_6$-alkyl;

m is 0, 1, or 2; and x is 0, 1, or 2.

In some embodiments, A is heterocyclyl optionally substituted with one or more $R^1$. In some embodiments, A is bicyclic heterocyclyl. In some embodiments, A is monocyclic nitrogen-containing heterocyclyl. In some embodiments, A is bicyclic nitrogen-containing heterocyclyl. In some embodiments, A is optionally substituted piperidinyl. In some embodiments, A is optionally substituted piperazinyl. In some embodiments, A is

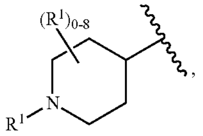

wherein each $R^1$ is independently hydrogen or $C_1$-$C_6$-alkyl. In some embodiments, A is

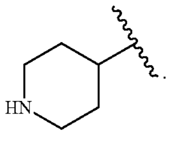

In some embodiments, A is

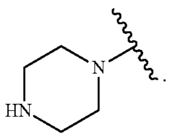

In some embodiments, each $R^{3a}$ is independently hydrogen or $C_1$-$C_6$-alkyl (e.g., $CH_3$). In some embodiments, each $R^{3a}$ is independently hydrogen. In some embodiments, each $R^{3a}$ is independently $C_1$-$C_6$-alkyl (e.g., $CH_3$).

In some embodiments, B is heteroaryl optionally substituted with one or more $R^1$. In some embodiments, B is monocyclic heteroaryl. In some embodiments, B is bicyclic heteroaryl. In some embodiments, B is monocyclic nitrogen-containing heteroaryl. In some embodiments, B is bicyclic nitrogen-containing heteroaryl. In some embodiments, B is optionally substituted pyrazolyl. In some embodiments, B is selected from

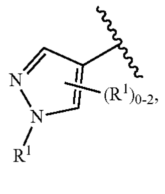

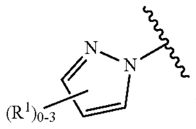
,

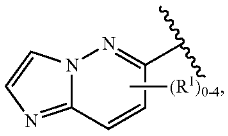

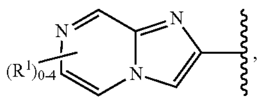
, and

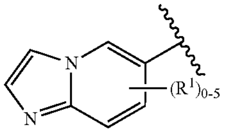

wherein each $R^1$ is as defined above. In some embodiments, B is
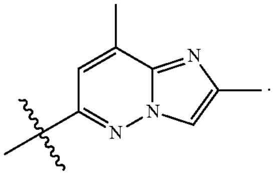 [SMILES: *c1cc(C)c2nc(C)cn2n1]
In some embodiments, B is
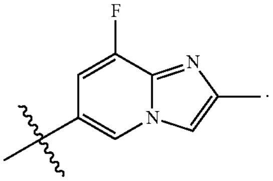 [SMILES: *c1cc(F)c2nc(C)cn2c1]
In some embodiments, A is selected from
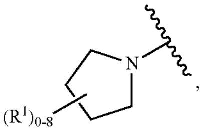, 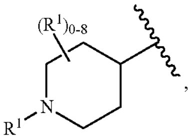, 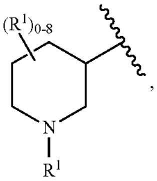, 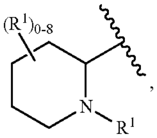, 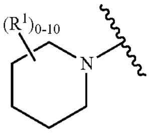, 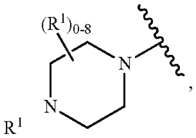, 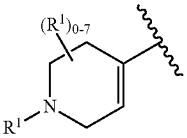, 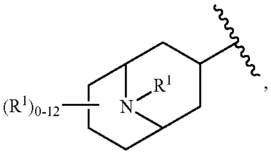, 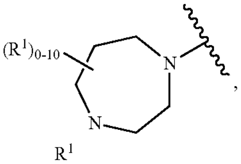, 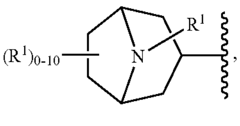, 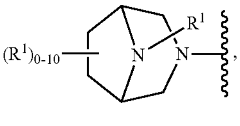, 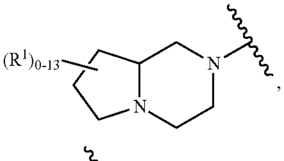, and
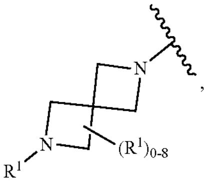,
wherein $R^1$ is as defined herein.
In some embodiments, A is selected from
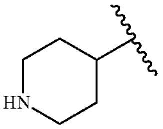, 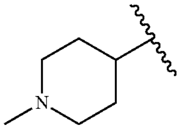, 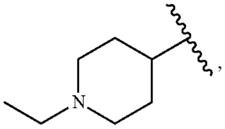, 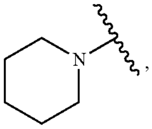, 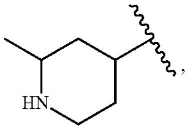, 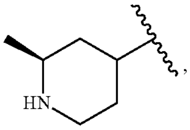, 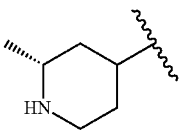, 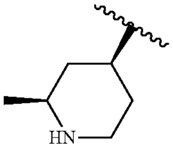, 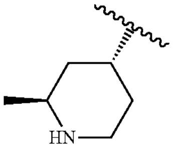, 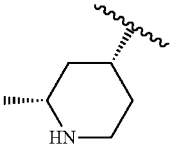, 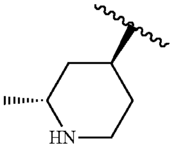, 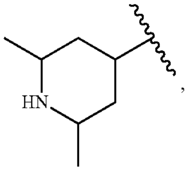, 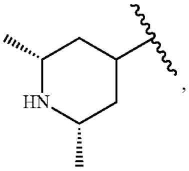, 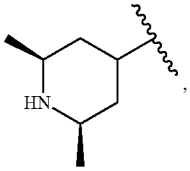, 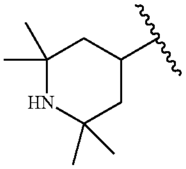, 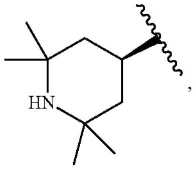, 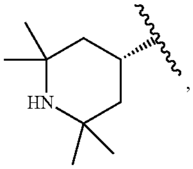, 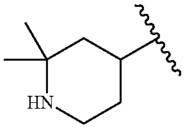, 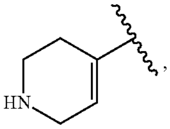, 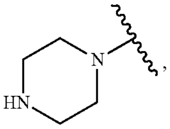, 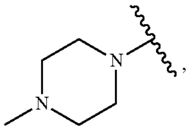, 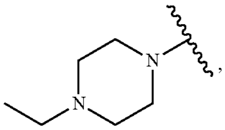, 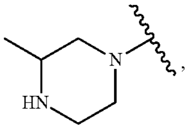, 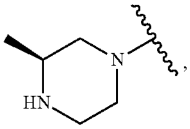, -continued
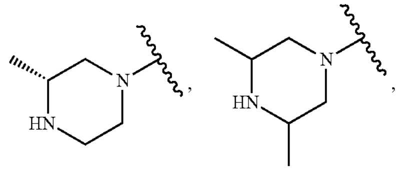
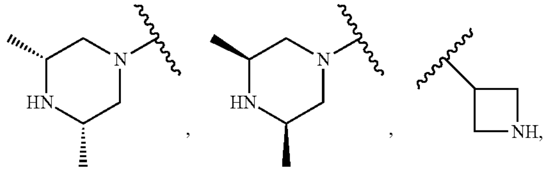
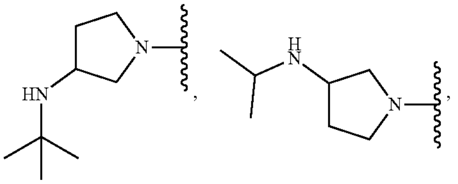
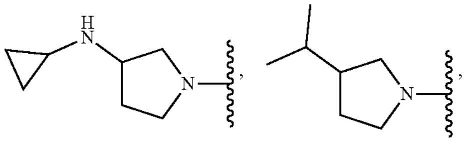
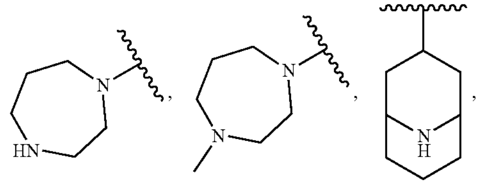
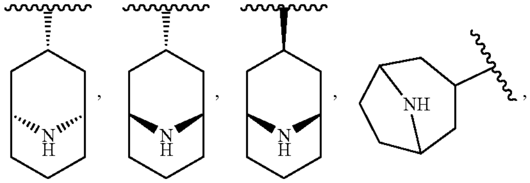
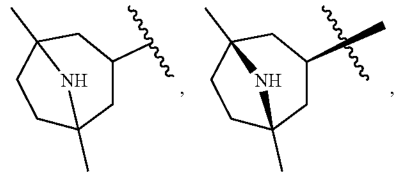
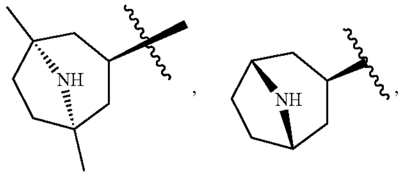
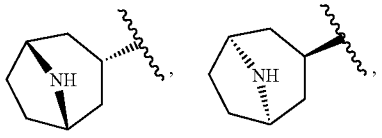
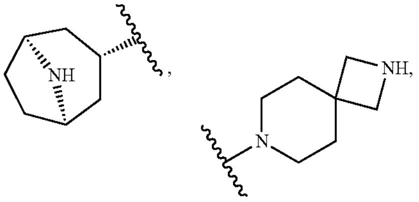
-continued
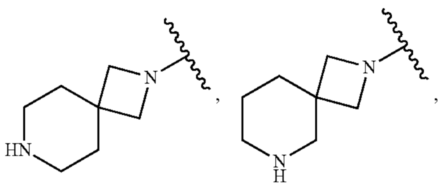
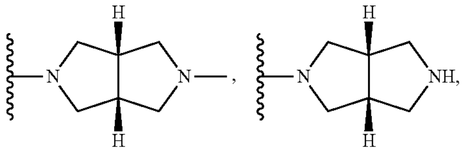
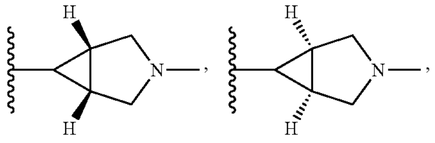
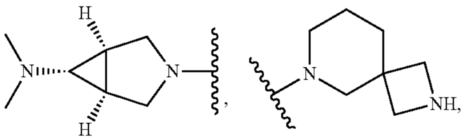
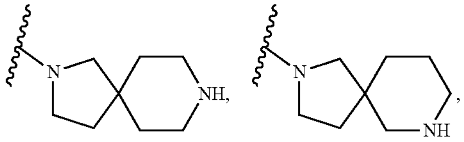
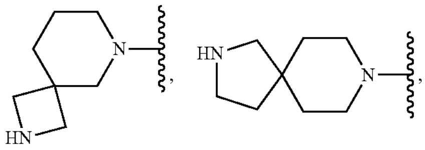
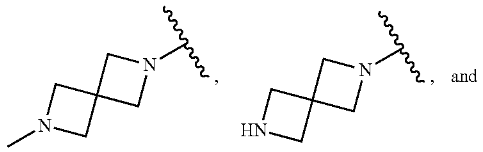
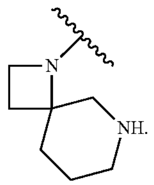
In some embodiments, A is selected from
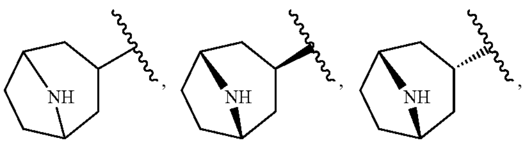
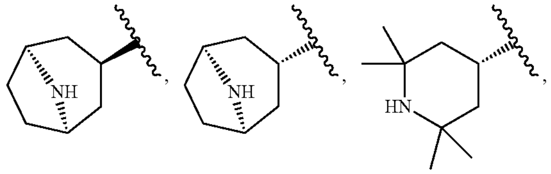

-continued
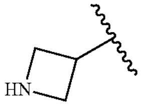, 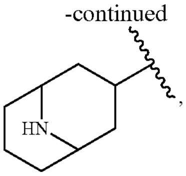, 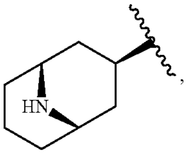,
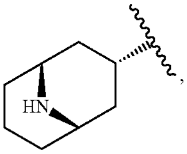, 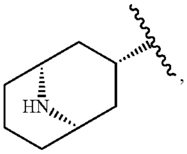, 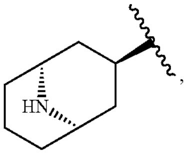,
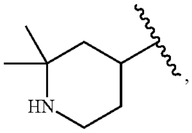, 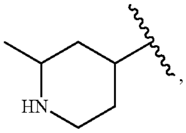, 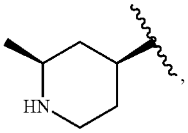,
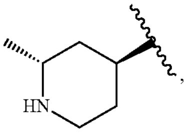, 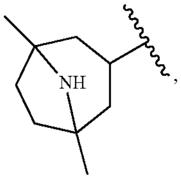,
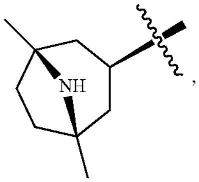, and 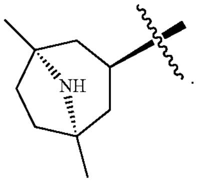.
In some embodiments, A is selected from
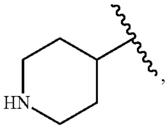, 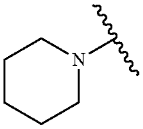 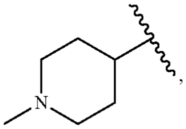,
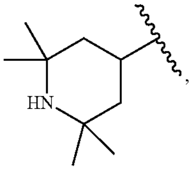, 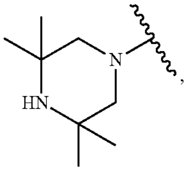,
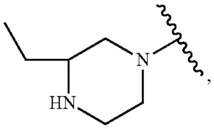, 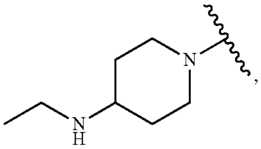,
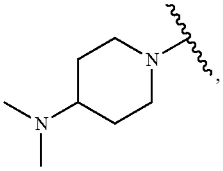, 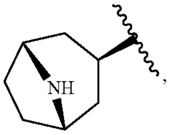,
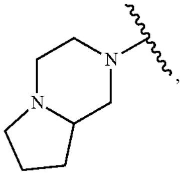, 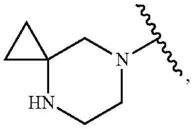, 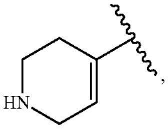,
-continued
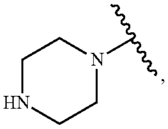, 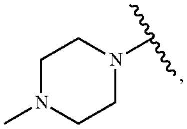,
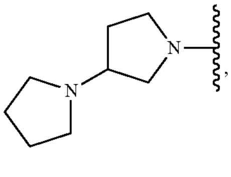, and 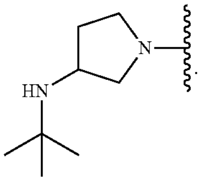.
In some embodiments, A is
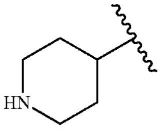.
In some embodiments, A is
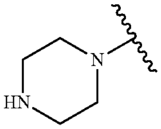.
In some embodiments, A is
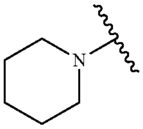.
In some embodiments, A is
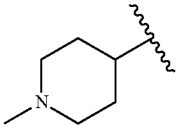.
In some embodiments, A is
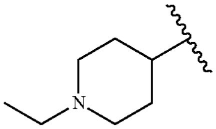.

In some embodiments, A is
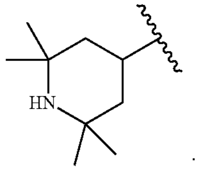 [SMILES: *C1CC(C)(C)NC(C)(C)C1]
In some embodiments, A is
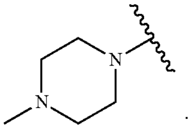 [SMILES: *N1CCN(C)CC1]
In some embodiments, A is
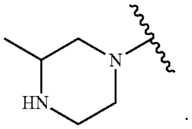 [SMILES: *N1CCNC(C)C1]
In some embodiments, A is
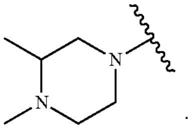 [SMILES: *N1CCN(C)C(C)C1]
In some embodiments, A is
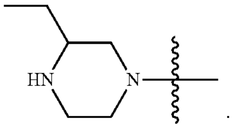
In some embodiments, A is
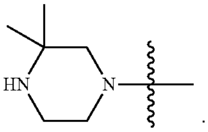 [SMILES: *N1CCNC(C)(C)C1]
In some embodiments, A is
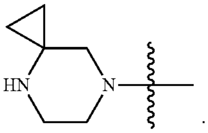 [SMILES: *N1CCNC2(CC2)C1]
In some embodiments, A is
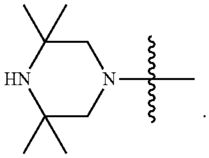 [SMILES: *N1CC(C)(C)NC(C)(C)C1]
In some embodiments, A is
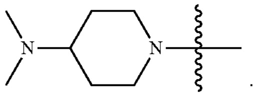
In some embodiments, A is
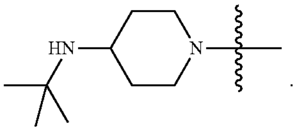 [SMILES: *N1CCC(NC(C)(C)C)CC1]
In some embodiments, A is
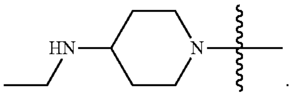
In some embodiments, A is
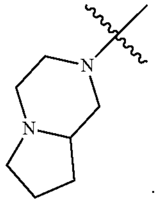 [SMILES: *N1CCN2CCCC2C1]
In some embodiments, A is
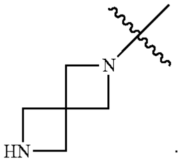 [SMILES: *N1CC2(CNC2)C1]
In some embodiments, A is
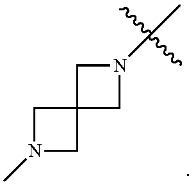 [SMILES: *N1CC2(C1)CN(C)C2]

In some embodiments, A is
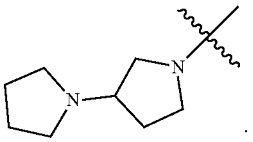 [SMILES: *N1CCC(N2CCCC2)C1]
In some embodiments, A is
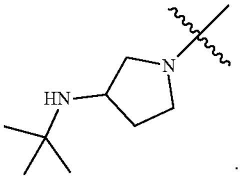 [SMILES: *N1CCC(NC(C)(C)C)C1]
In some embodiments, A is
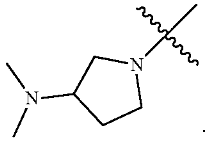 [SMILES: *N1CCC(N(C)C)C1]
In some embodiments, A is
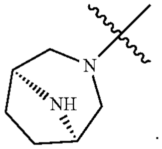 [SMILES: *N1C[C@H]2CC[C@@H](C1)N2]
In some embodiments, A is
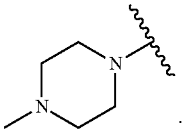 [SMILES: *N1CCN(C)CC1]
In some embodiments, A is
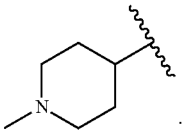 [SMILES: *C1CCN(C)CC1]
In some embodiments, A is
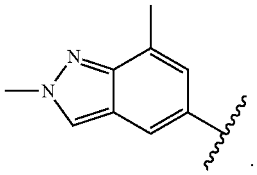 [SMILES: *c1cc(C)c2nn(C)cc2c1]
In some embodiments, A is
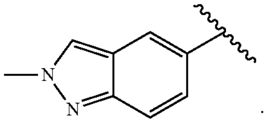 [SMILES: *c1ccc2nn(C)cc2c1]
In some embodiments, B is selected from
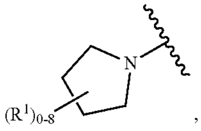, 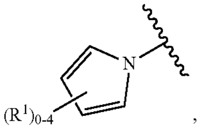,
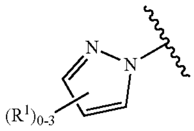, and 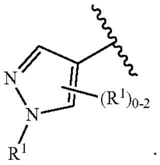.
In some embodiments, B is selected from
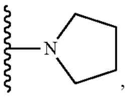, 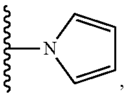, 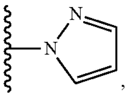, and
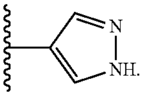
In some embodiments, B is selected from
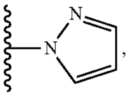, 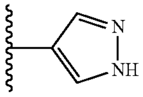, 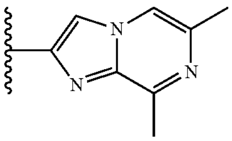,
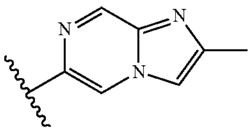, 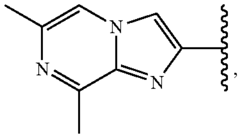, -continued
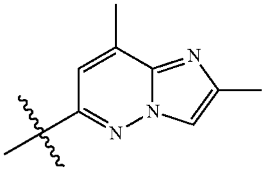,
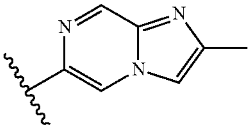,
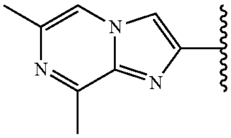,
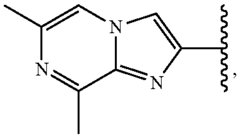,
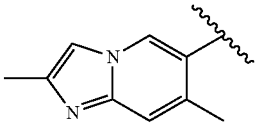,
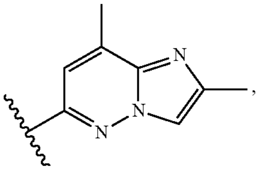,
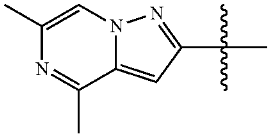,
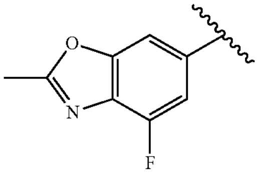,
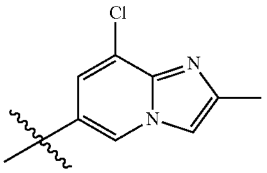,
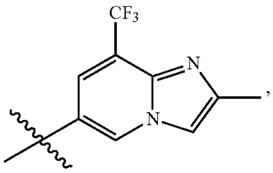,
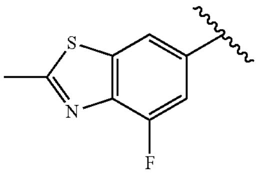,
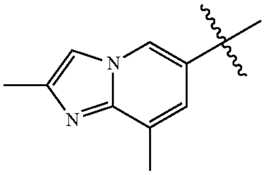,
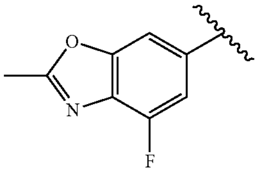,
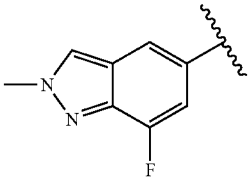,
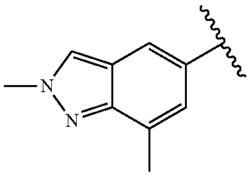, and
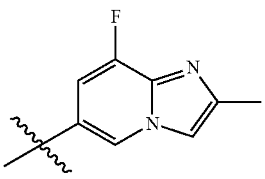.
In some embodiments, B is selected from
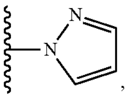,
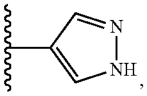,
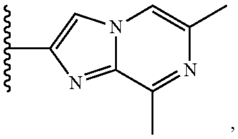,
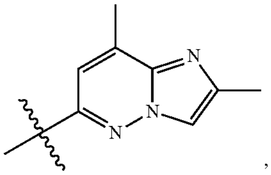,
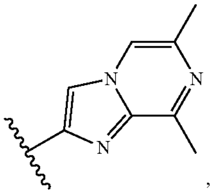,
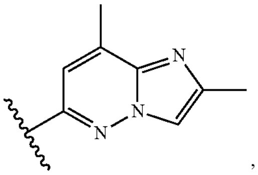,
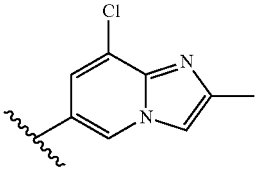,
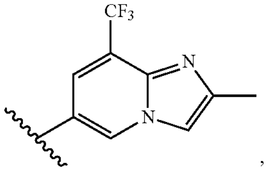, and
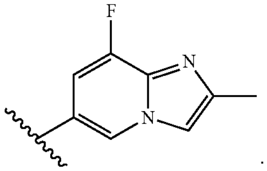.
In some embodiments, B is selected is
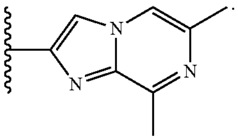 [SMILES: *c1cn2cc(C)nc(C)c2n1].
In some embodiments, B is
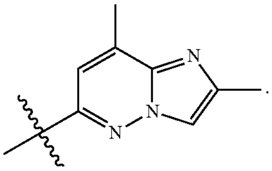 [SMILES: *c1cc(C)c2nc(C)cn2n1].

In some embodiments, B is
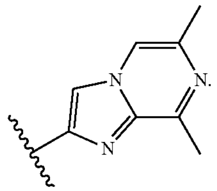 [SMILES: *c1cn2cc(C)nc(C)c2n1]
In some embodiments, B is
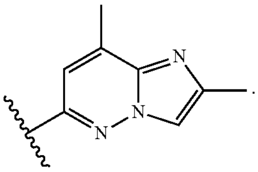 [SMILES: *c1cc(C)c2nc(C)cn2n1]
In some embodiments, B is
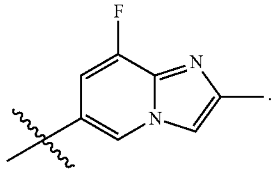 [SMILES: *c1cc(F)c2nc(C)cn2c1]
In some embodiments, the compound of Formula (I) is selected from a compound in Table 1, or a pharmaceutically acceptable salt, solvate, hydrate, tautomer, or stereoisomer thereof.
TABLE 1
| Exemplary compounds of Formula (I) | |
|---|---|
| Compound No. | Structure |
| 118 | 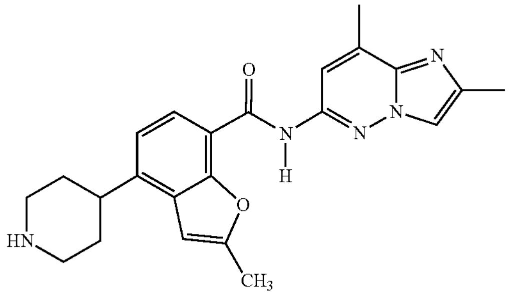 [SMILES: Cc1cn2nc(NC(=O)c3ccc(C4CCNCC4)c4cc(C)oc34)cc(C)c2n1] |
| 119 | 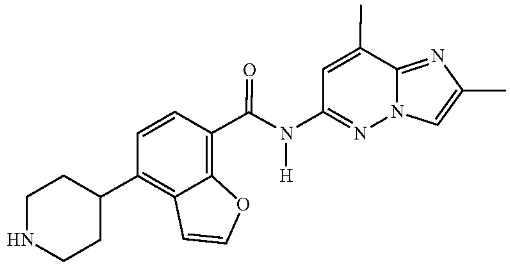 |
| 140 | 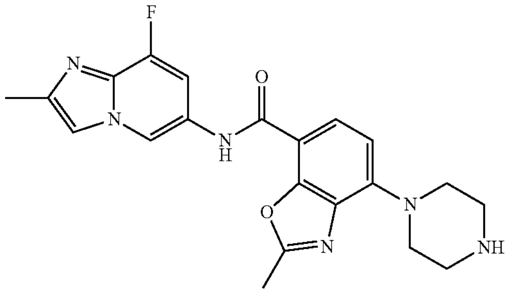 [SMILES: Cc1cn2cc(NC(=O)c3ccc(N4CCNCC4)c4nc(C)oc34)cc(F)c2n1] |

TABLE 1-continued
| Exemplary compounds of Formula (I) | |
| --- | --- |
| Compound No. | Structure |
| 141 | 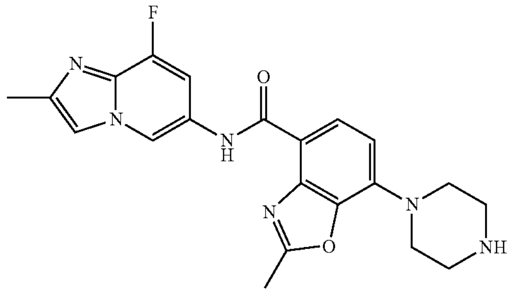 [SMILES: Cc1cn2cc(NC(=O)c3ccc(N4CCNCC4)c4oc(C)nc34)cc(F)c2n1] |
| 142 | 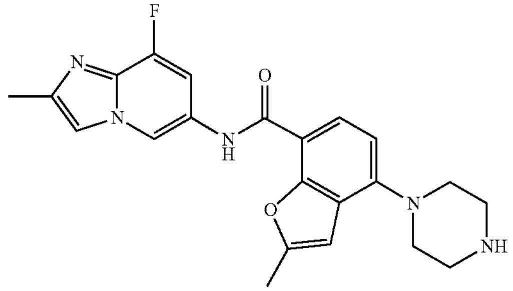 [SMILES: Cc1cn2cc(NC(=O)c3ccc(N4CCNCC4)c4cc(C)oc34)cc(F)c2n1] |
| 143 | 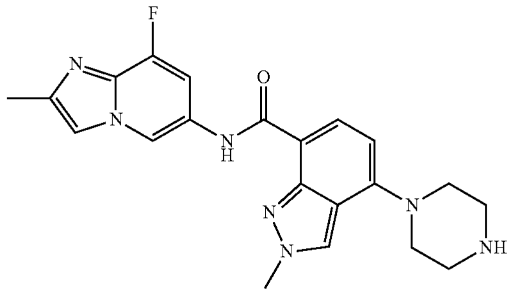 [SMILES: Cc1cn2cc(NC(=O)c3ccc(N4CCNCC4)c4cn(C)nc34)cc(F)c2n1] |
| 145 | 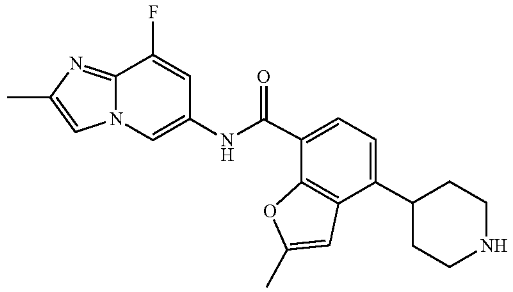 [SMILES: Cc1cn2cc(NC(=O)c3ccc(C4CCNCC4)c4cc(C)oc34)cc(F)c2n1] |
| 146 | 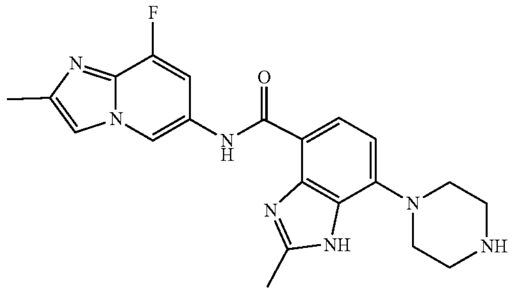 [SMILES: Cc1cn2cc(NC(=O)c3ccc(N4CCNCC4)c4[nH]c(C)nc34)cc(F)c2n1] |

TABLE 1-continued
| Exemplary compounds of Formula (I) | |
|---|---|
| Compound No. | Structure |
| 147 | 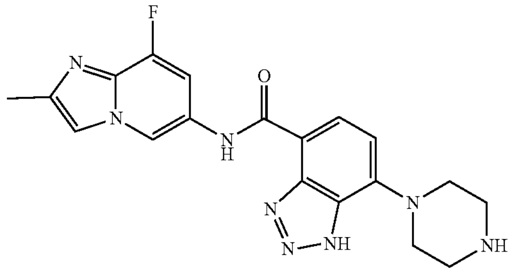 [SMILES: Cc1cn2cc(NC(=O)c3ccc(N4CCNCC4)c4[nH]nnc34)cc(F)c2n1] |
| 148 | 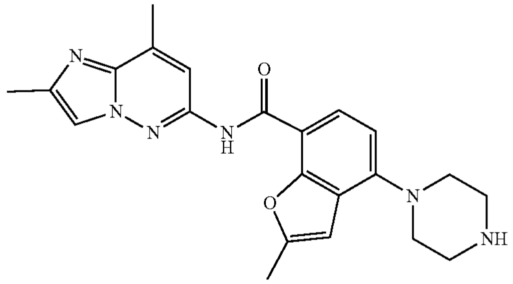 [SMILES: Cc1cn2nc(NC(=O)c3ccc(N4CCNCC4)c4cc(C)oc34)cc(C)c2n1] |
| 149 | 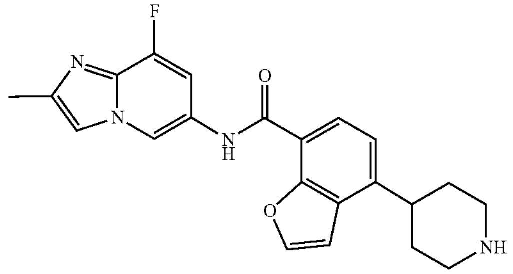 [SMILES: Cc1cn2cc(NC(=O)c3ccc(C4CCNCC4)c4ccoc34)cc(F)c2n1] |
| 150 | 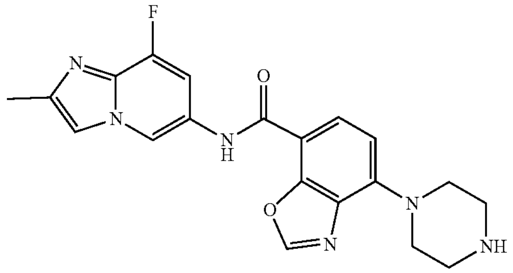 [SMILES: Cc1cn2cc(NC(=O)c3ccc(N4CCNCC4)c4ncoc34)cc(F)c2n1] |
| 187 | 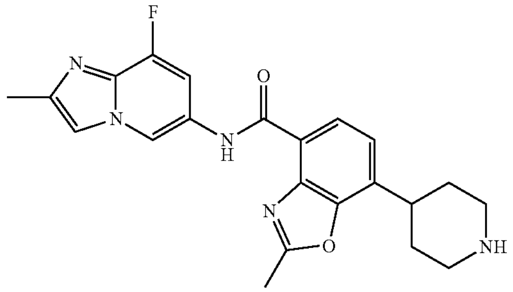 [SMILES: Cc1cn2cc(NC(=O)c3ccc(C4CCNCC4)c4oc(C)nc34)cc(F)c2n1] |

TABLE 1-continued
| Compound No. | Structure |
| --- | --- |
| Exemplary compounds of Formula (I) | |
| 188 | 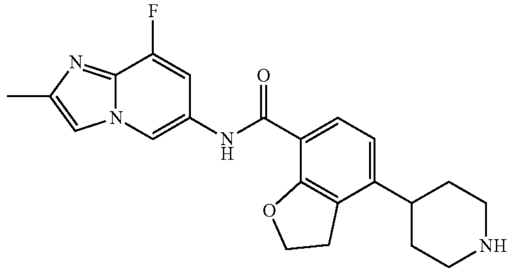 [SMILES: Cc1cn2cc(NC(=O)c3ccc(C4CCNCC4)c4c3OCC4)cc(F)c2n1] |
| 189 | 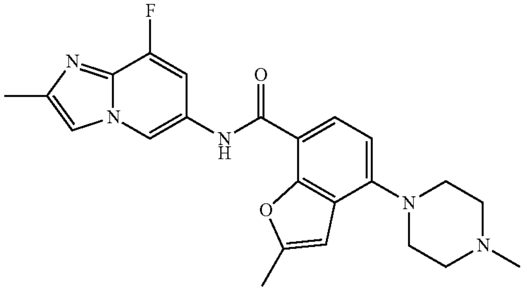 |
| 190 | 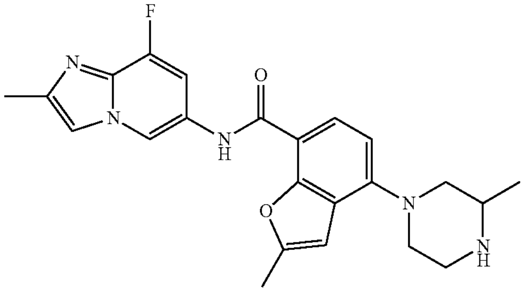 |
| 191 | 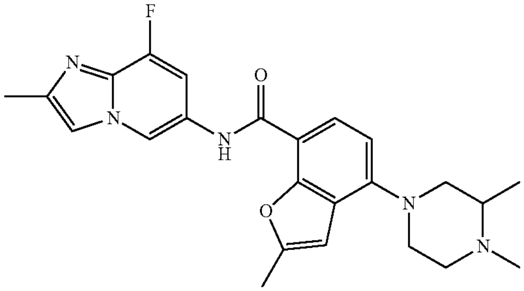 |
| 192 | 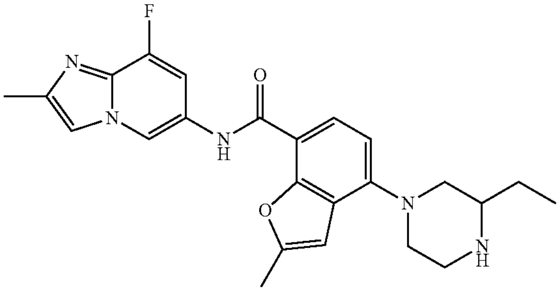 [SMILES: CCC1CN(c2ccc(C(=O)Nc3cc(F)c4nc(C)cn4c3)c3oc(C)cc23)CCN1] |

TABLE 1-continued
| Exemplary compounds of Formula (I) | |
|---|---|
| Compound No. | Structure |
| 193 | 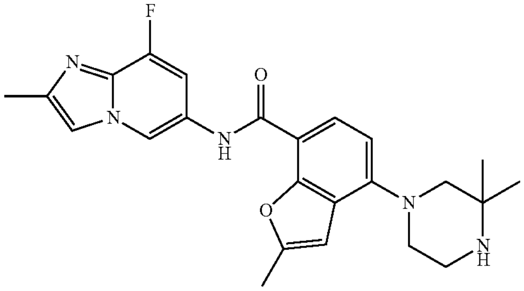 |
| 194 | 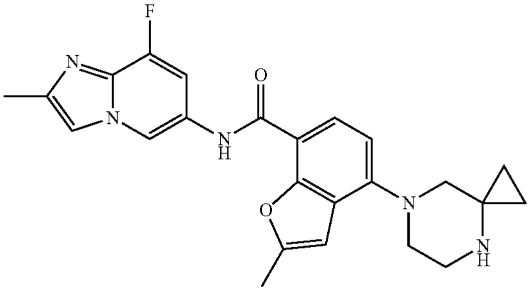 [SMILES: Cc1cn2cc(NC(=O)c3ccc(N4CCNC5(CC5)C4)c4cc(C)oc34)cc(F)c2n1] |
| 195 | 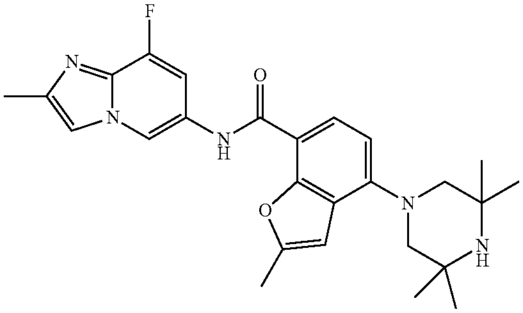 |
| 196 | 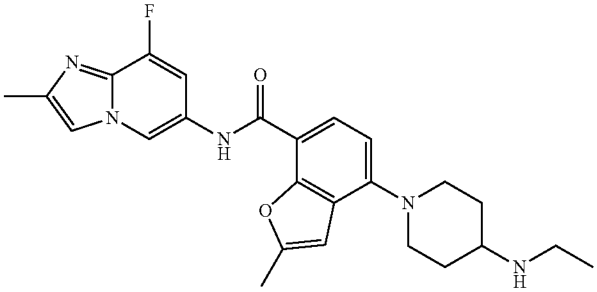 [SMILES: CCNC1CCN(c2ccc(C(=O)Nc3cc(F)c4nc(C)cn4c3)c3oc(C)cc23)CC1] |
| 197 | 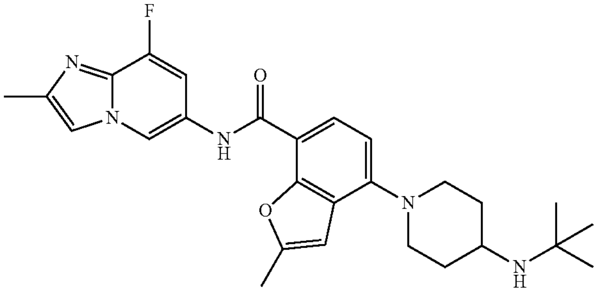 [SMILES: Cc1cn2cc(NC(=O)c3ccc(N4CCC(NC(C)(C)C)CC4)c4cc(C)oc34)cc(F)c2n1] |

TABLE 1-continued
| Compound No. | Structure |
| --- | --- |
| | Exemplary compounds of Formula (I) |
| 198 | 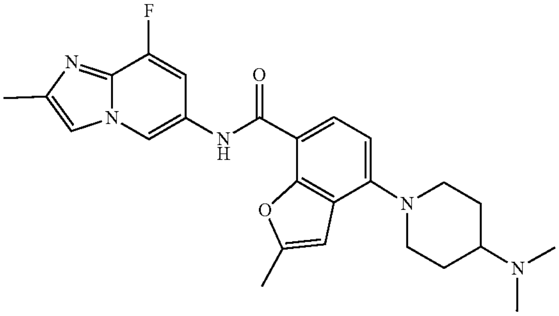 |
| 199 | 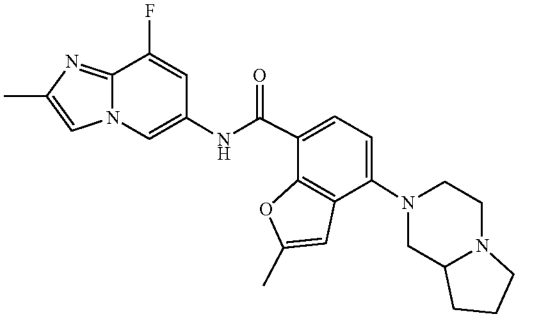 [SMILES: Cc1cn2cc(NC(=O)c3ccc(N4CCN5CCCC5C4)c4cc(C)oc34)cc(F)c2n1] |
| 200 | 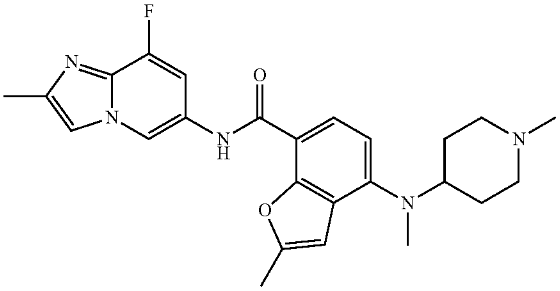 |
| 201 | 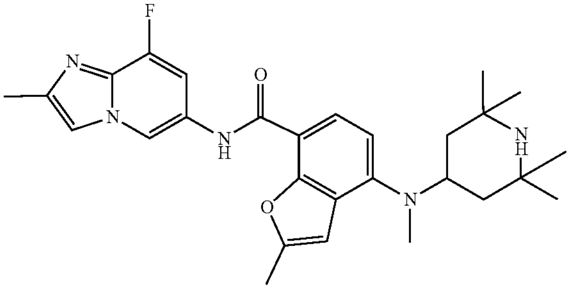 [SMILES: CCC1(C)CC(N(C)c2ccc(C(=O)Nc3cc(F)c4nc(C)cn4c3)c3oc(C)cc23)CC(C)(C)N1] |
| 202 | 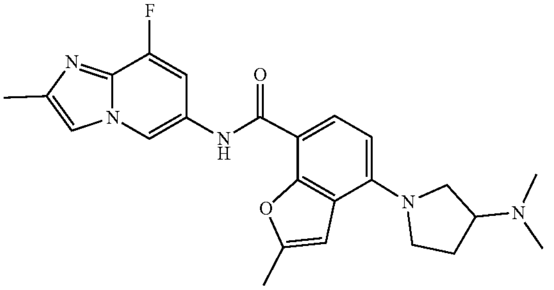 |

TABLE 1-continued
| Exemplary compounds of Formula (I) | |
|---|---|
| Compound No. | Structure |
| 203 | 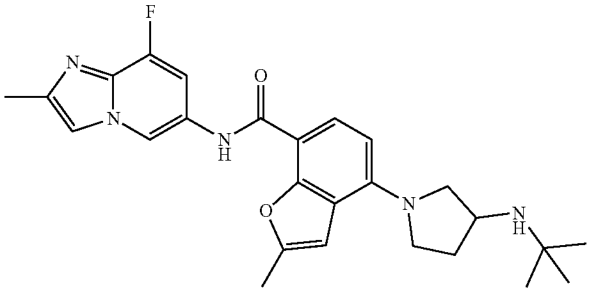 [SMILES: Cc1cn2cc(NC(=O)c3ccc(N4CCC(NC(C)(C)C)C4)c4cc(C)oc34)cc(F)c2n1] |
| 204 | 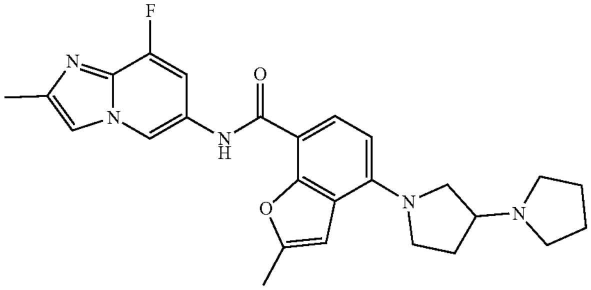 [SMILES: Cc1cn2cc(NC(=O)c3ccc(N4CCC(N5CCCC5)C4)c4cc(C)oc34)cc(F)c2n1] |
| 205 | 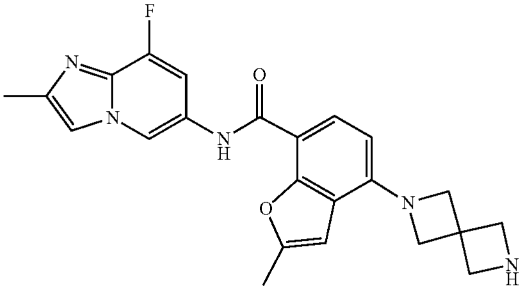 [SMILES: Cc1cn2cc(NC(=O)c3ccc(N4CC5(CNC5)C4)c4cc(C)oc34)cc(F)c2n1] |
| 206 | 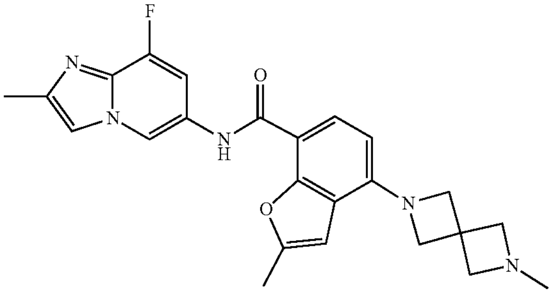 |
| 207 | 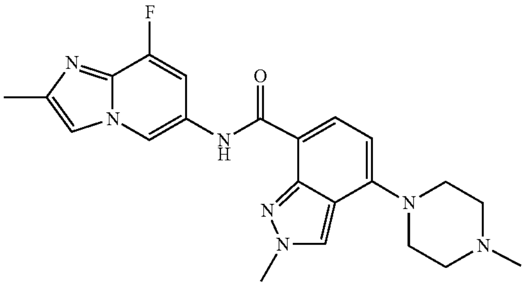 |

TABLE 1-continued
| Exemplary compounds of Formula (I) | |
|---|---|
| Compound No. | Structure |
| 208 | 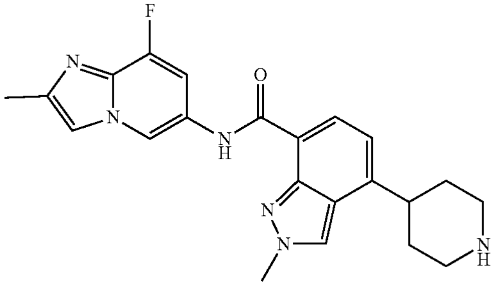 |
| 209 | 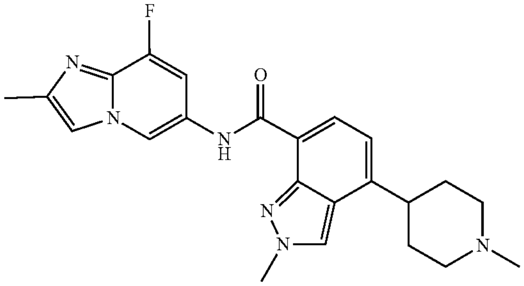 |
| 210 | 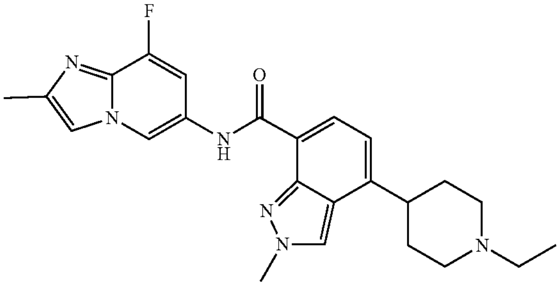 |
| 211 | 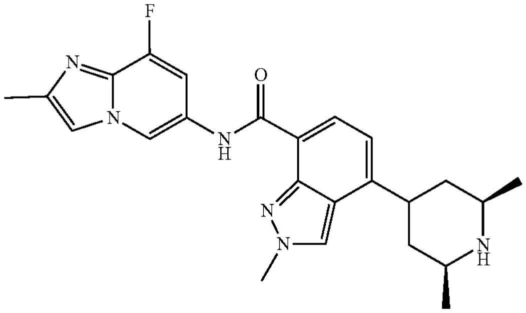 |
| 212 | 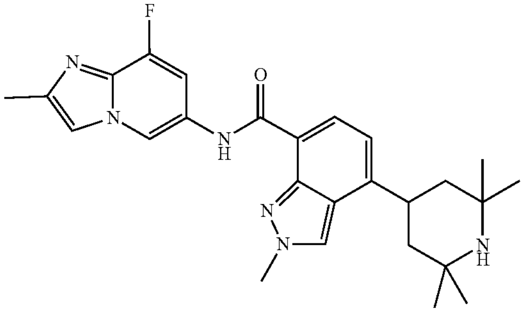 |

TABLE 1-continued
| Exemplary compounds of Formula (I) | |
|---|---|
| Compound No. | Structure |
| 217 | 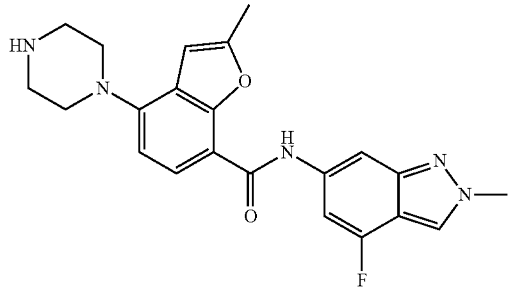 [SMILES: Cc1cc2c(N3CCNCC3)ccc(C(=O)Nc3cc(F)c4cn(C)nc4c3)c2o1] |
| 218 | 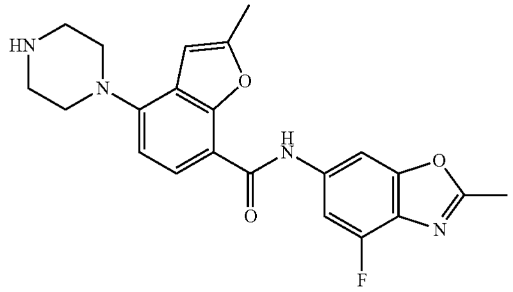 [SMILES: Cc1cc2c(N3CCNCC3)ccc(C(=O)Nc3cc(F)c4nc(C)oc4c3)c2o1] |
| 219 | 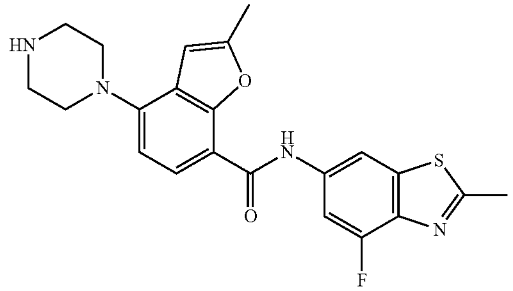 [SMILES: Cc1cc2c(N3CCNCC3)ccc(C(=O)Nc3cc(F)c4nc(C)sc4c3)c2o1] |
| 228 | 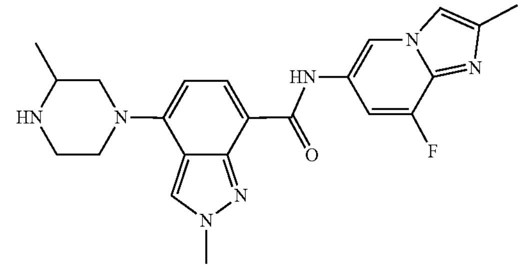 [SMILES: Cc1cn2cc(NC(=O)c3ccc(N4CCNC(C)C4)c4cn(C)nc34)cc(F)c2n1] |
| 229 | 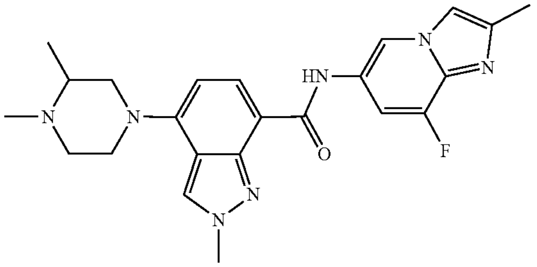

TABLE 1-continued
| Exemplary compounds of Formula (I) | |
|---|---|
| Compound No. | Structure |
| 230 | 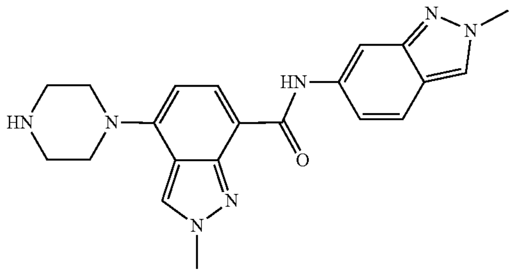 [SMILES: Cn1cc2ccc(NC(=O)c3ccc(N4CCNCC4)c4cn(C)nc34)cc2n1] |
| 231 | 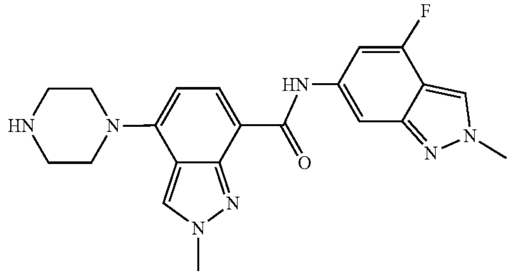 [SMILES: Cn1cc2c(F)cc(NC(=O)c3ccc(N4CCNCC4)c4cn(C)nc34)cc2n1] |
| 234 | 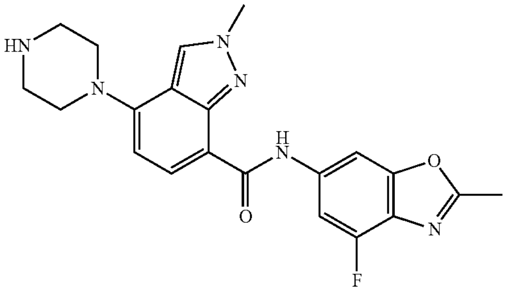 [SMILES: Cc1nc2c(F)cc(NC(=O)c3ccc(N4CCNCC4)c4cn(C)nc34)cc2o1] |
| 235 | 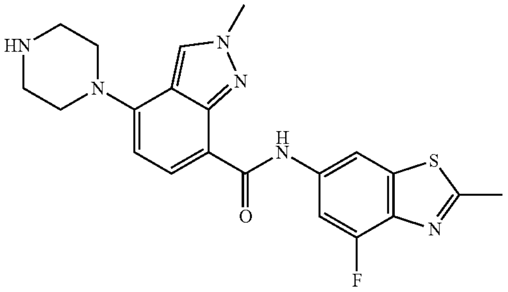 [SMILES: Cc1nc2c(F)cc(NC(=O)c3ccc(N4CCNCC4)c4cn(C)nc34)cc2s1] |
| 237 | 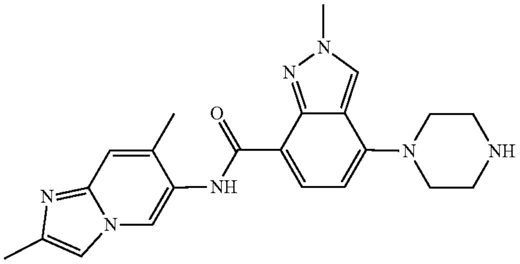 [SMILES: Cc1cn2cc(NC(=O)c3ccc(N4CCNCC4)c4cn(C)nc34)c(C)cc2n1] |

TABLE 1-continued
| Exemplary compounds of Formula (I) | |
|---|---|
| Compound No. | Structure |
| 238 | 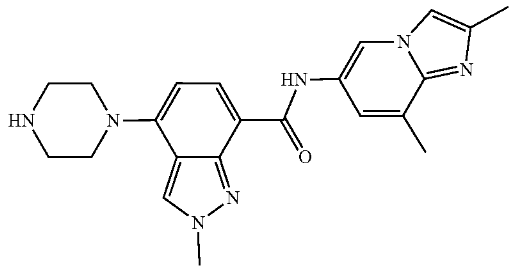 [SMILES: Cc1cn2cc(NC(=O)c3ccc(N4CCNCC4)c4cn(C)nc34)cc(C)c2n1] |
| 239 | 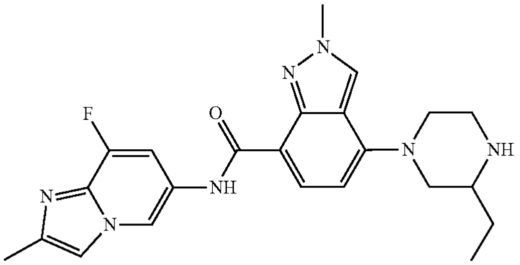 [SMILES: CCC1CN(c2ccc(C(=O)Nc3cc(F)c4nc(C)cn4c3)c3nn(C)cc23)CCN1] |
| 240 | 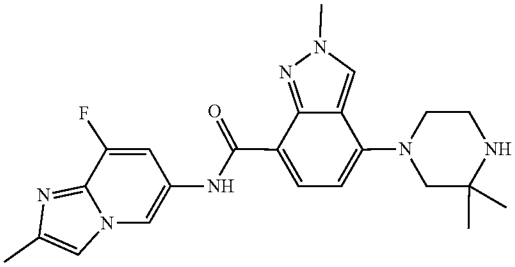 |
| 241 | 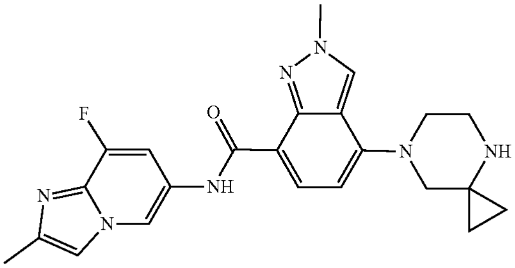 [SMILES: Cc1cn2cc(NC(=O)c3ccc(N4CCNC5(CC5)C4)c4cn(C)nc34)cc(F)c2n1] |
| 242 | 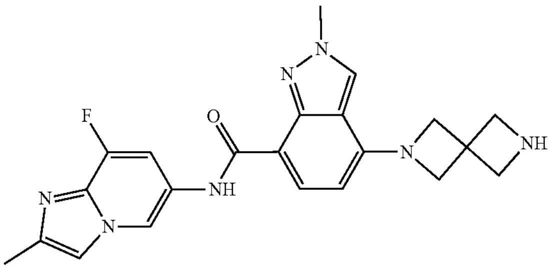 [SMILES: Cc1cn2cc(NC(=O)c3ccc(N4CC5(CNC5)C4)c4cn(C)nc34)cc(F)c2n1] |

TABLE 1-continued
| Exemplary compounds of Formula (I) | |
|---|---|
| Compound No. | Structure |
| 243 | 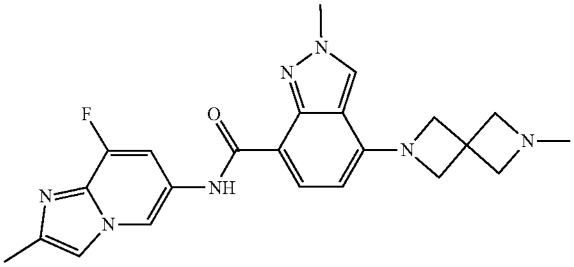 |
| 244 | 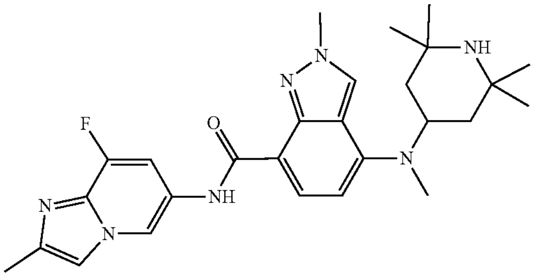 |
| 245 | 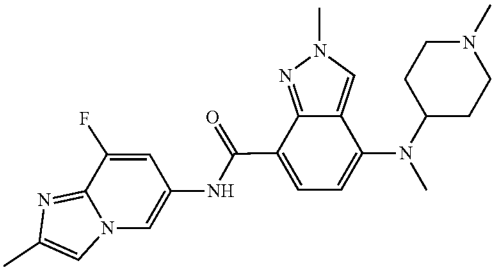 |
| 246 | 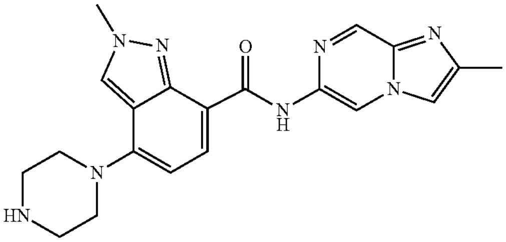 [SMILES: Cc1cn2cc(NC(=O)c3ccc(N4CCNCC4)c4cn(C)nc34)ncc2n1] |
| 247 | 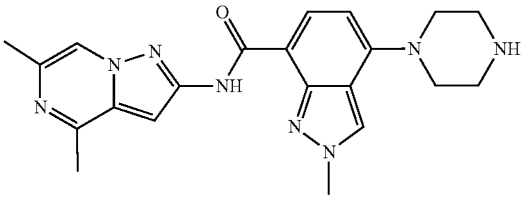 [SMILES: Cc1cn2nc(NC(=O)c3ccc(N4CCNCC4)c4cn(C)nc34)cc2c(C)n1] |

TABLE 1-continued
| Exemplary compounds of Formula (I) | |
|---|---|
| Compound No. | Structure |
| 249 | 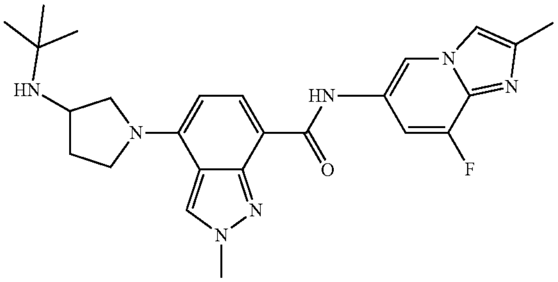 [SMILES: Cc1cn2cc(NC(=O)c3ccc(N4CCC(NC(C)(C)C)C4)c4cn(C)nc34)cc(F)c2n1] |
| 250 | 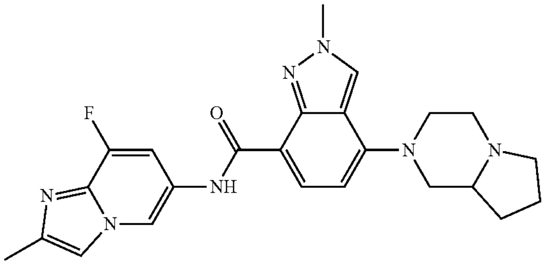 [SMILES: Cc1cn2cc(NC(=O)c3ccc(N4CCN5CCCC5C4)c4cn(C)nc34)cc(F)c2n1] |
| 251 | 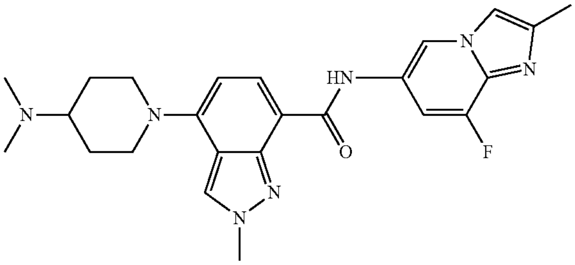 |
| 252 | 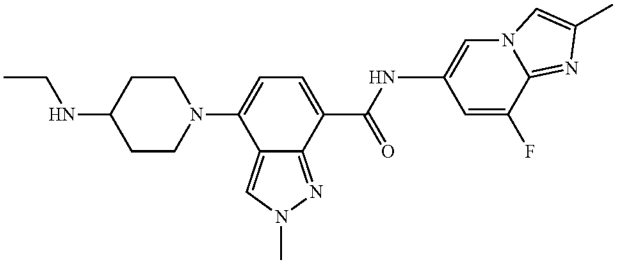 [SMILES: CCNC1CCN(c2ccc(C(=O)Nc3cc(F)c4nc(C)cn4c3)c3nn(C)cc23)CC1] |
| 253 | 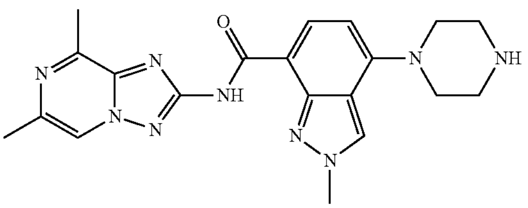 [SMILES: Cc1cn2nc(NC(=O)c3ccc(N4CCNCC4)c4cn(C)nc34)nc2c(C)n1] |

TABLE 1-continued
| Exemplary compounds of Formula (I) | |
|---|---|
| Compound No. | Structure |
| 255 | 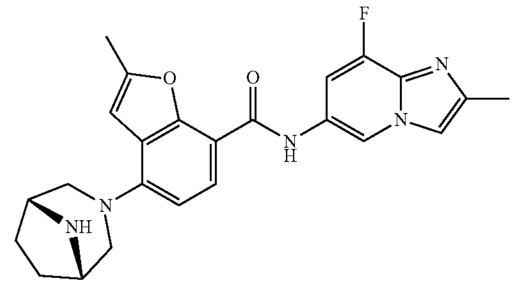 [SMILES: Cc1cn2cc(NC(=O)c3ccc(N4C[C@H]5CC[C@@H](C4)N5)c4cc(C)oc34)cc(F)c2n1] |
| 256 | 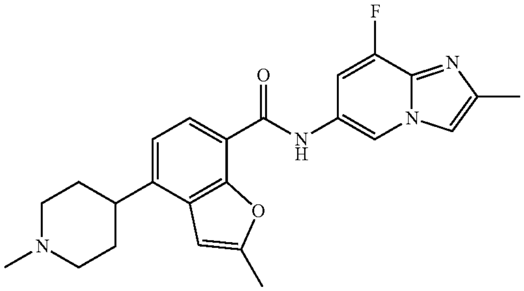 |
| 257 | 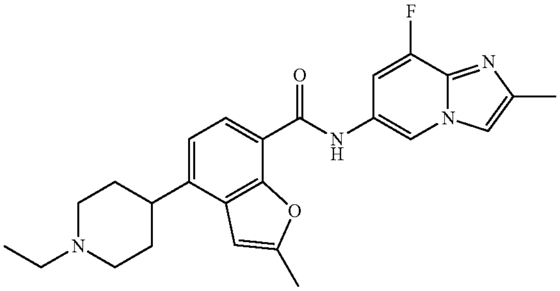 [SMILES: CCN1CCC(c2ccc(C(=O)Nc3cc(F)c4nc(C)cn4c3)c3oc(C)cc23)CC1] |
| 258 | 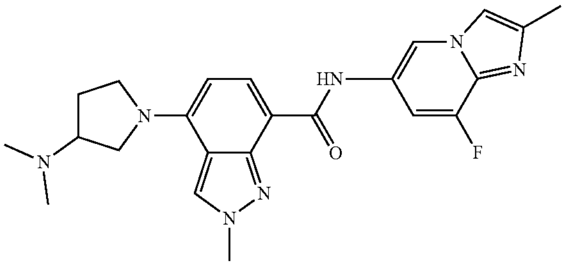 |
| 259 | 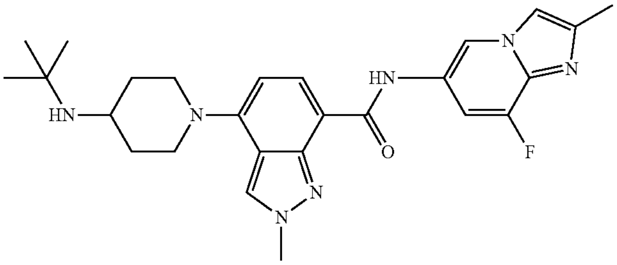 [SMILES: Cc1cn2cc(NC(=O)c3ccc(N4CCC(NC(C)(C)C)CC4)c4cn(C)nc34)cc(F)c2n1] |

TABLE 1-continued
| Exemplary compounds of Formula (I) | |
|---|---|
| Compound No. | Structure |
| 260 | 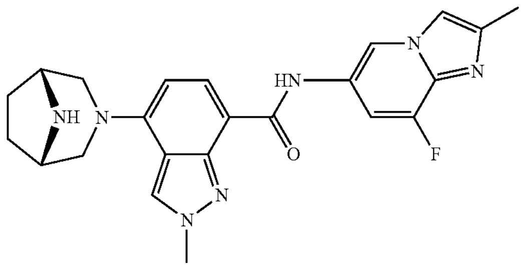 [SMILES: Cc1cn2cc(NC(=O)c3ccc(N4C[C@H]5CC[C@@H](C4)N5)c4cn(C)nc34)cc(F)c2n1] |
| 261 | 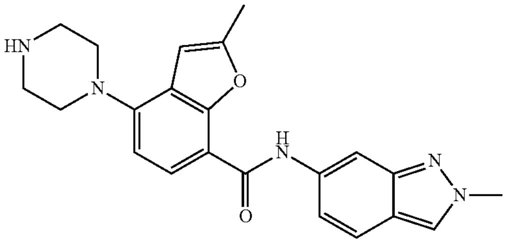 [SMILES: Cc1cc2c(N3CCNCC3)ccc(C(=O)Nc3ccc4cn(C)nc4c3)c2o1] |
| 262 | 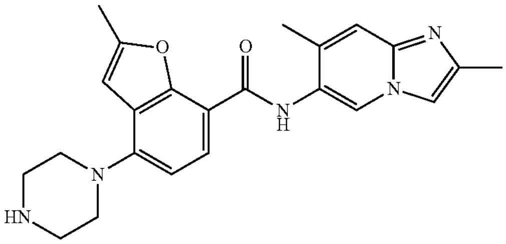 [SMILES: Cc1cn2cc(NC(=O)c3ccc(N4CCNCC4)c4cc(C)oc34)c(C)cc2n1] |
| 263 | 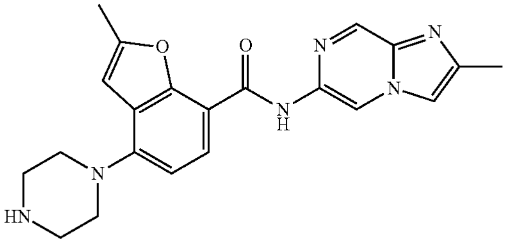 [SMILES: Cc1cn2cc(NC(=O)c3ccc(N4CCNCC4)c4cc(C)oc34)ncc2n1] |
| 264 | 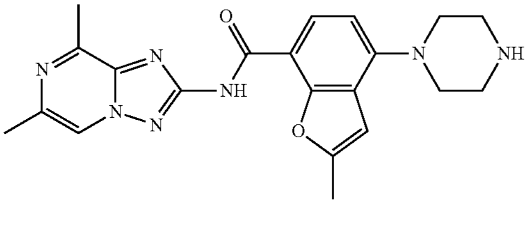 [SMILES: Cc1cn2nc(NC(=O)c3ccc(N4CCNCC4)c4cc(C)oc34)nc2c(C)n1] |
| 265 | 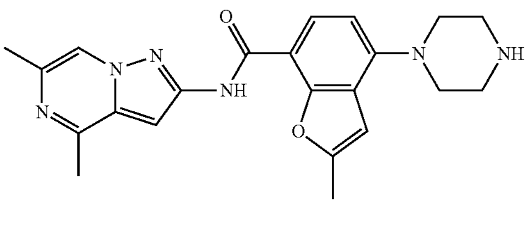 [SMILES: Cc1cn2nc(NC(=O)c3ccc(N4CCNCC4)c4cc(C)oc34)cc2c(C)n1] |

TABLE 1-continued
| Exemplary compounds of Formula (I) | |
|---|---|
| Compound No. | Structure |
| 266 | 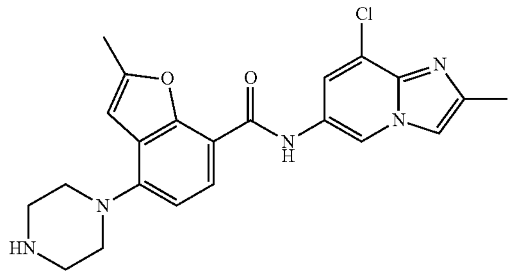 [SMILES: Cc1cn2cc(NC(=O)c3ccc(N4CCNCC4)c4cc(C)oc34)cc(Cl)c2n1] |
| 267 | 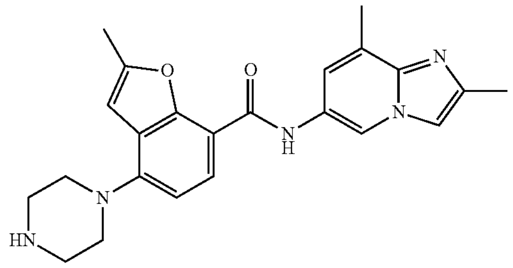 [SMILES: Cc1cn2cc(NC(=O)c3ccc(N4CCNCC4)c4cc(C)oc34)cc(C)c2n1] |
| 268 | 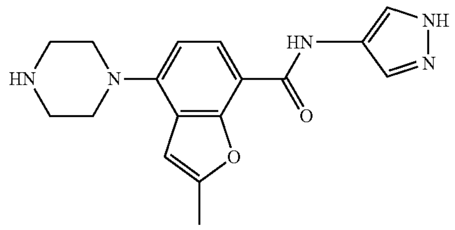 [SMILES: Cc1cc2c(N3CCNCC3)ccc(C(=O)Nc3cn[nH]c3)c2o1] |
| 269 | 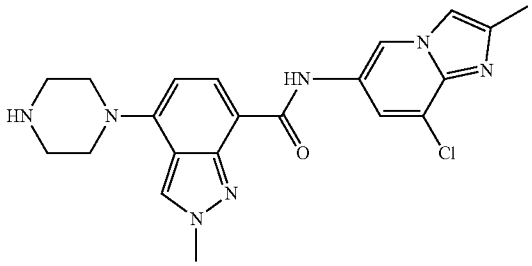 [SMILES: Cc1cn2cc(NC(=O)c3ccc(N4CCNCC4)c4cn(C)nc34)cc(Cl)c2n1] |
| 270 | 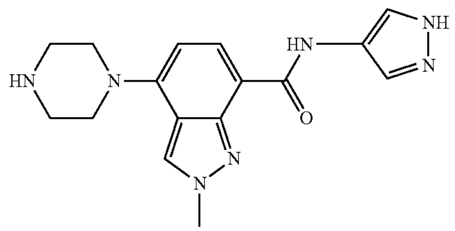 [SMILES: Cn1cc2c(N3CCNCC3)ccc(C(=O)Nc3cn[nH]c3)c2n1] |

TABLE 1-continued
| Exemplary compounds of Formula (I) | |
|---|---|
| Compound No. | Structure |
| 271 | 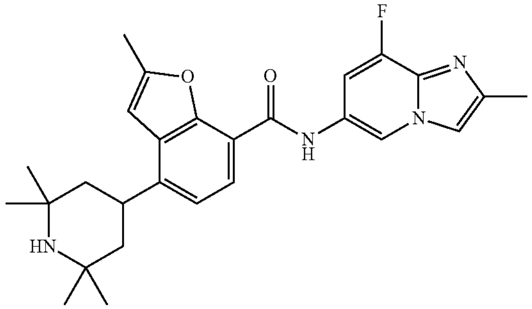 |
| 272 | 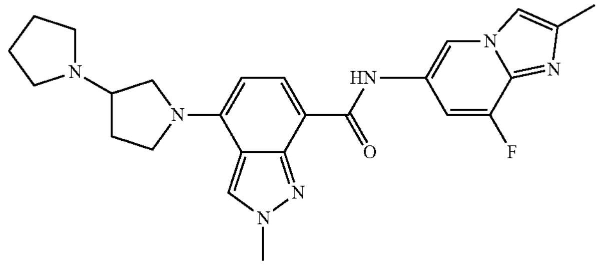 [SMILES: Cc1cn2cc(NC(=O)c3ccc(N4CCC(N5CCCC5)C4)c4cn(C)nc34)cc(F)c2n1] |
| 273 | 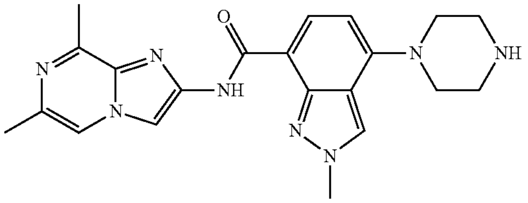 [SMILES: Cc1cn2cc(NC(=O)c3ccc(N4CCNCC4)c4cn(C)nc34)nc2c(C)n1] |
| 274 | 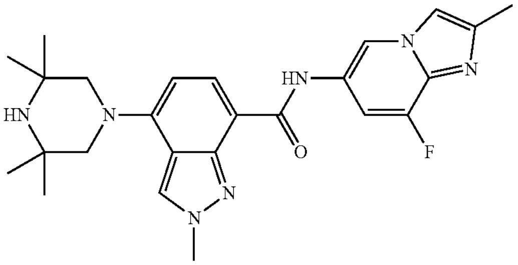 |
| 275 | 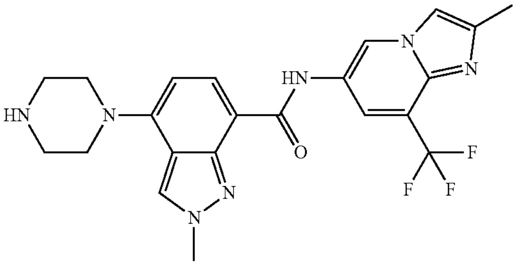 [SMILES: Cc1cn2cc(NC(=O)c3ccc(N4CCNCC4)c4cn(C)nc34)cc(C(F)(F)F)c2n1] |

TABLE 1-continued
| Exemplary compounds of Formula (I) | |
|---|---|
| Compound No. | Structure |
| 277 | 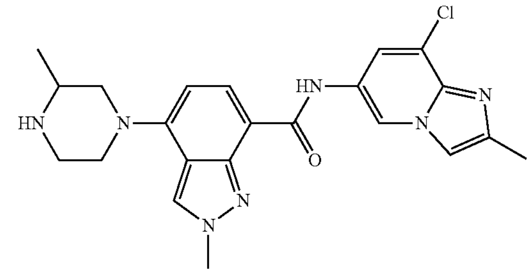 [SMILES: Cc1cn2cc(NC(=O)c3ccc(N4CCNC(C)C4)c4cn(C)nc34)cc(Cl)c2n1] |
| 278 | 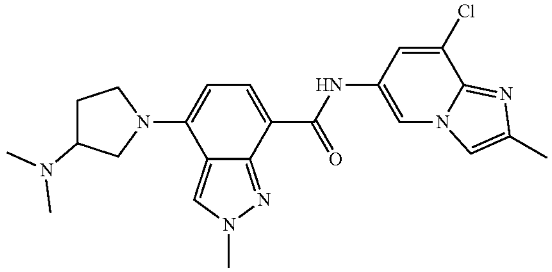 |
| 279 | 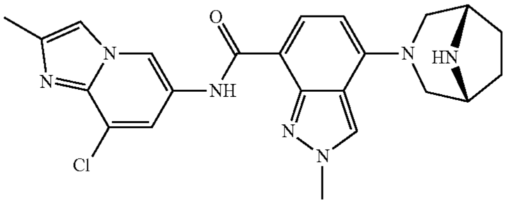 [SMILES: Cc1cn2cc(NC(=O)c3ccc(N4C[C@H]5CC[C@@H](C4)N5)c4cn(C)nc34)cc(Cl)c2n1] |
| 280 | 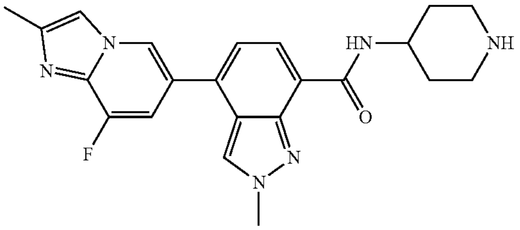 [SMILES: Cc1cn2cc(-c3ccc(C(=O)NC4CCNCC4)c4nn(C)cc34)cc(F)c2n1] |
| 281 | 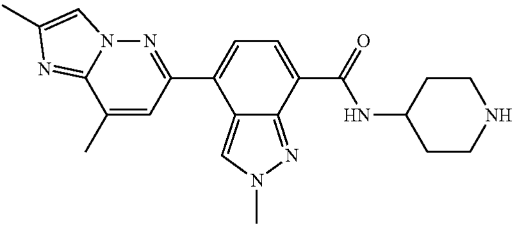 [SMILES: Cc1cn2nc(-c3ccc(C(=O)NC4CCNCC4)c4nn(C)cc34)cc(C)c2n1] |
| 282 | 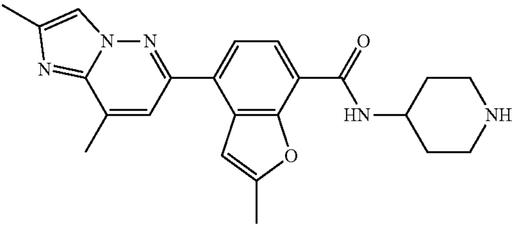 [SMILES: Cc1cn2nc(-c3ccc(C(=O)NC4CCNCC4)c4oc(C)cc34)cc(C)c2n1] |

TABLE 1-continued

| Exemplary compounds of Formula (I) | |
|---|---|
| Compound No. | Structure |
| 283 | 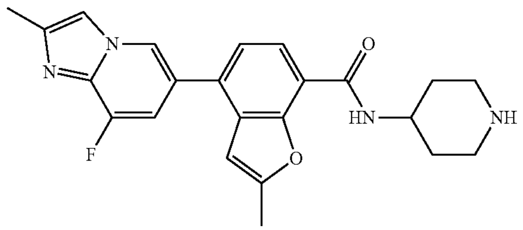 [SMILES: Cc1cn2cc(-c3ccc(C(=O)NC4CCNCC4)c4oc(C)cc34)cc(F)c2n1] |
| 284 | 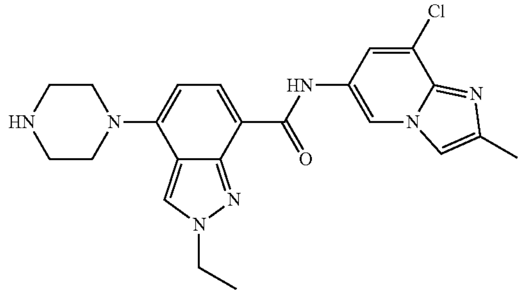 [SMILES: CCn1cc2c(N3CCNCC3)ccc(C(=O)Nc3cc(Cl)c4nc(C)cn4c3)c2n1] |
| 285 | 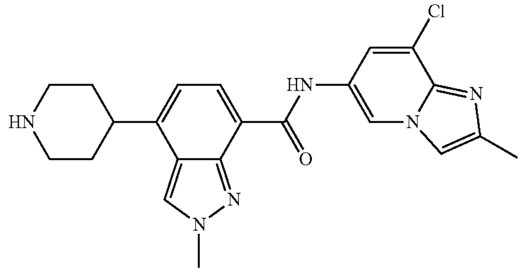 [SMILES: Cc1cn2cc(NC(=O)c3ccc(C4CCNCC4)c4cn(C)nc34)cc(Cl)c2n1] |
| 286 | 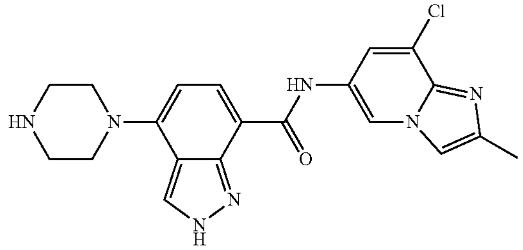 [SMILES: Cc1cn2cc(NC(=O)c3ccc(N4CCNCC4)c4c[nH]nc34)cc(Cl)c2n1] |
| 287 | 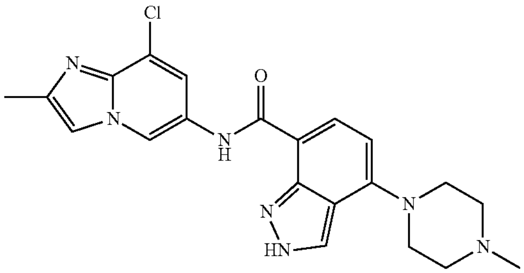 |

In some embodiments, for Formula (I), A is monocyclic heterocyclyl (e.g., piperidinyl); B is bicyclic heteroaryl (e.g., imidazo[1,2-b]pyridazinyl); $L^2$ is —C(O)N($R^4$)— (e.g., —C(O)N(H)—); X is C($R^{3a}$) (e.g., CH); Y is C($R^{3a}$) (e.g., C($CH_3$)); Z is O; y is 0; and m is 0. In some embodiments, the compound of Formulas (I), (I-d), (I-e), and (I-f) is Compound 118, or a pharmaceutically acceptable salt, solvate, hydrate, tautomer, or stereoisomer thereof.

In some embodiments, for Formula (I), A is monocyclic heterocyclyl (e.g., piperidinyl); B is bicyclic heteroaryl (e.g., imidazo[1,2-b]pyridazinyl); $L^2$ is —C(O)N($R^4$)— (e.g., —C(O)N(H)—); X and Y are each independently C($R^{3a}$) (e.g., CH); Z is O; y is 0; and m is 0. In some embodiments, the compound of Formulas (I), (I-d), (I-e), and I-f) is Compound 119, or a pharmaceutically acceptable salt, solvate, hydrate, tautomer, or stereoisomer thereof. In some embodiments, the compound of Formulas (I), (I-a), (I-e) and II-f) is one of Compounds 140-150.

In some embodiments, for Formula (I), A is monocyclic heterocyclyl (e.g., piperidinyl); B is bicyclic heteroaryl (e.g., imidazo[1,2-b]pyridazinyl); $L^1$ is absent or —$N(R^4)$—; and $L^2$ is absent or —$C(O)N(R^4)$— (e.g., —C(O)N(H)—). In some embodiments, for Formula (I), the compound is selected from Compound 118, 141, 228, 229, 242, 243, 269, and 277.

Pharmaceutical Compositions, Kits, and Administration

The present invention provides pharmaceutical compositions comprising a compound of Formula (I), e.g., a compound of Formula (I) or a pharmaceutically acceptable salt, solvate, hydrate, tautomer, or stereoisomer, as described herein, and optionally a pharmaceutically acceptable excipient. In certain embodiments, the pharmaceutical composition described herein comprises a compound of Formula (I) or a pharmaceutically acceptable salt thereof, and optionally a pharmaceutically acceptable excipient. In certain embodiments, the compound of Formula (I) or a pharmaceutically acceptable salt, solvate, hydrate, tautomer, or stereoisomer thereof, is provided in an effective amount in the pharmaceutical composition. In certain embodiments, the effective amount is a therapeutically effective amount. In certain embodiments, the effective amount is a prophylactically effective amount.

Pharmaceutical compositions described herein can be prepared by any method known in the art of pharmacology. In general, such preparatory methods include the steps of bringing the compound of Formula (I) (the "active ingredient") into association with a carrier and/or one or more other accessory ingredients, and then, if necessary and/or desirable, shaping and/or packaging the product into a desired single- or multi-dose unit.

Pharmaceutical compositions can be prepared, packaged, and/or sold in bulk, as a single unit dose, and/or as a plurality of single unit doses. As used herein, a "unit dose" is a discrete amount of the pharmaceutical composition comprising a predetermined amount of the active ingredient. The amount of the active ingredient is generally equal to the dosage of the active ingredient which would be administered to a subject and/or a convenient fraction of such a dosage such as, for example, one-half or one-third of such a dosage.

Relative amounts of the active ingredient, the pharmaceutically acceptable excipient, and/or any additional ingredients in a pharmaceutical composition of the invention will vary, depending upon the identity, size, and/or condition of the subject treated and further depending upon the route by which the composition is to be administered. By way of example, the composition may comprise between 0.1% and 100% (w/w) active ingredient.

The term "pharmaceutically acceptable excipient" refers to a non-toxic carrier, adjuvant, diluent, or vehicle that does not destroy the pharmacological activity of the compound with which it is formulated. Pharmaceutically acceptable excipients useful in the manufacture of the pharmaceutical compositions of the invention are any of those that are well known in the art of pharmaceutical formulation and include inert diluents, dispersing and/or granulating agents, surface active agents and/or emulsifiers, disintegrating agents, binding agents, preservatives, buffering agents, lubricating agents, and/or oils. Pharmaceutically acceptable excipients useful in the manufacture of the pharmaceutical compositions of the invention include, but are not limited to, ion exchangers, alumina, aluminum stearate, lecithin, serum proteins, such as human serum albumin, buffer substances such as phosphates, glycine, sorbic acid, potassium sorbate, partial glyceride mixtures of saturated vegetable fatty acids, water, salts or electrolytes, such as protamine sulfate, disodium hydrogen phosphate, potassium hydrogen phosphate, sodium chloride, zinc salts, colloidal silica, magnesium trisilicate, polyvinyl pyrrolidone, cellulose-based substances, polyethylene glycol, sodium carboxymethylcellulose, polyacrylates, waxes, polyethylene-polyoxypropylene-block polymers, polyethylene glycol and wool fat.

Compositions of the present invention may be administered orally, parenterally (including subcutaneous, intramuscular, intravenous and intradermal), by inhalation spray, topically, rectally, nasally, buccally, vaginally or via an implanted reservoir. In some embodiments, provided compounds or compositions are administrable intravenously and/or orally.

The term "parenteral" as used herein includes subcutaneous, intravenous, intramuscular, intraocular, intravitreal, intra-articular, intra-synovial, intrasternal, intrathecal, intrahepatic, intraperitoneal intralesional and intracranial injection or infusion techniques. Preferably, the compositions are administered orally, subcutaneously, intraperitoneally, or intravenously. Sterile injectable forms of the compositions of this invention may be aqueous or oleaginous suspension. These suspensions may be formulated according to techniques known in the art using suitable dispersing or wetting agents and suspending agents. The sterile injectable preparation may also be a sterile injectable solution or suspension in a non-toxic parenterally acceptable diluent or solvent, for example as a solution in 1,3-butanediol. Among the acceptable vehicles and solvents that may be employed are water, Ringer's solution and isotonic sodium chloride solution. In addition, sterile, fixed oils are conventionally employed as a solvent or suspending medium.

Pharmaceutically acceptable compositions of this invention may be orally administered in any orally acceptable dosage form including, but not limited to, capsules, tablets, aqueous suspensions or solutions. In the case of tablets for oral use, carriers commonly used include lactose and corn starch. Lubricating agents, such as magnesium stearate, are also typically added. For oral administration in a capsule form, useful diluents include lactose and dried cornstarch. When aqueous suspensions are required for oral use, the active ingredient is combined with emulsifying and suspending agents. If desired, certain sweetening, flavoring or coloring agents may also be added. In some embodiments, a provided oral formulation is formulated for immediate release or sustained/delayed release. In some embodiments, the composition is suitable for buccal or sublingual administration, including tablets, lozenges and pastilles. A provided compound can also be in micro-encapsulated form.

Alternatively, pharmaceutically acceptable compositions of this invention may be administered in the form of suppositories for rectal administration. Pharmaceutically acceptable compositions of this invention may also be administered topically, especially when the target of treatment includes areas or organs readily accessible by topical application, including diseases of the eye, the skin, or the lower intestinal tract. Suitable topical formulations are readily prepared for each of these areas or organs.

For ophthalmic use, provided pharmaceutically acceptable compositions may be formulated as micronized suspensions or in an ointment such as petrolatum.

In order to prolong the effect of a drug, it is often desirable to slow the absorption of the drug from subcutaneous or intramuscular injection. This can be accomplished by the use of a liquid suspension of crystalline or amorphous material with poor water solubility. The rate of absorption of the drug then depends upon its rate of dissolution which, in turn, may depend upon crystal size and crystalline form. Alternatively, delayed absorption of a parenterally administered drug form is accomplished by dissolving or suspending the drug in an oil vehicle.

Although the descriptions of pharmaceutical compositions provided herein are principally directed to pharmaceutical compositions which are suitable for administration to humans, it will be understood by the skilled artisan that such compositions are generally suitable for administration to animals of all sorts. Modification of pharmaceutical compositions suitable for administration to humans in order to render the compositions suitable for administration to various animals is well understood, and the ordinarily skilled veterinary pharmacologist can design and/or perform such modification with ordinary experimentation.

Compounds provided herein are typically formulated in dosage unit form, e.g., single unit dosage form, for ease of administration and uniformity of dosage. It will be understood, however, that the total daily usage of the compositions of the present invention will be decided by the attending physician within the scope of sound medical judgment. The specific therapeutically effective dose level for any particular subject or organism will depend upon a variety of factors including the disease being treated and the severity of the disorder; the activity of the specific active ingredient employed; the specific composition employed; the age, body weight, general health, sex and diet of the subject; the time of administration, route of administration, and rate of excretion of the specific active ingredient employed; the duration of the treatment; drugs used in combination or coincidental with the specific active ingredient employed; and like factors well known in the medical arts.

The exact amount of a compound required to achieve an effective amount will vary from subject to subject, depending, for example, on species, age, and general condition of a subject, severity of the side effects or disorder, identity of the particular compound(s), mode of administration, and the like. The desired dosage can be delivered three times a day, two times a day, once a day, every other day, every third day, every week, every two weeks, every three weeks, or every four weeks. In certain embodiments, the desired dosage can be delivered using multiple administrations (e.g., two, three, four, five, six, seven, eight, nine, ten, eleven, twelve, thirteen, fourteen, or more administrations).

In certain embodiments, an effective amount of a compound for administration one or more times a day to a 70 kg adult human may comprise about 0.0001 mg to about 3000 mg, about 0.0001 mg to about 2000 mg, about 0.0001 mg to about 1000 mg, about 0.001 mg to about 1000 mg, about 0.01 mg to about 1000 mg, about 0.1 mg to about 1000 mg, about 1 mg to about 1000 mg, about 1 mg to about 100 mg, about 10 mg to about 1000 mg, or about 100 mg to about 1000 mg, of a compound per unit dosage form.

In certain embodiments, the compounds of Formula (I) may be at dosage levels sufficient to deliver from about 0.001 mg/kg to about 100 mg/kg, from about 0.01 mg/kg to about 50 mg/kg, preferably from about 0.1 mg/kg to about 40 mg/kg, preferably from about 0.5 mg/kg to about 30 mg/kg, from about 0.01 mg/kg to about 10 mg/kg, from about 0.1 mg/kg to about 10 mg/kg, and more preferably from about 1 mg/kg to about 25 mg/kg, of subject body weight per day, one or more times a day, to obtain the desired therapeutic effect.

It will be appreciated that dose ranges as described herein provide guidance for the administration of provided pharmaceutical compositions to an adult. The amount to be administered to, for example, a child or an adolescent can be determined by a medical practitioner or person skilled in the art and can be lower or the same as that administered to an adult.

It will be also appreciated that a compound or composition, as described herein, can be administered in combination with one or more additional pharmaceutical agents. The compounds or compositions can be administered in combination with additional pharmaceutical agents that improve their bioavailability, reduce and/or modify their metabolism, inhibit their excretion, and/or modify their distribution within the body. It will also be appreciated that the therapy employed may achieve a desired effect for the same disorder, and/or it may achieve different effects.

The compound or composition can be administered concurrently with, prior to, or subsequent to, one or more additional pharmaceutical agents, which may be useful as, e.g., combination therapies. Pharmaceutical agents include therapeutically active agents. Pharmaceutical agents also include prophylactically active agents. Each additional pharmaceutical agent may be administered at a dose and/or on a time schedule determined for that pharmaceutical agent. The additional pharmaceutical agents may also be administered together with each other and/or with the compound or composition described herein in a single dose or administered separately in different doses. The particular combination to employ in a regimen will take into account compatibility of the inventive compound with the additional pharmaceutical agents and/or the desired therapeutic and/or prophylactic effect to be achieved. In general, it is expected that the additional pharmaceutical agents utilized in combination be utilized at levels that do not exceed the levels at which they are utilized individually. In some embodiments, the levels utilized in combination will be lower than those utilized individually.

Exemplary additional pharmaceutical agents include, but are not limited to, anti-proliferative agents, anti-cancer agents, anti-diabetic agents, anti-inflammatory agents, immunosuppressant agents, and a pain-relieving agent. Pharmaceutical agents include small organic molecules such as drug compounds (e.g., compounds approved by the U.S. Food and Drug Administration as provided in the Code of Federal Regulations (CFR)), peptides, proteins, carbohydrates, monosaccharides, oligosaccharides, polysaccharides, nucleoproteins, mucoproteins, lipoproteins, synthetic polypeptides or proteins, small molecules linked to proteins, glycoproteins, steroids, nucleic acids, DNAs, RNAs, nucleotides, nucleosides, oligonucleotides, antisense oligonucleotides, lipids, hormones, vitamins, and cells.

Also encompassed by the invention are kits (e.g., pharmaceutical packs). The inventive kits may be useful for preventing and/or treating a proliferative disease or a non-proliferative disease, e.g., as described herein. The kits provided may comprise an inventive pharmaceutical composition or compound and a container (e.g., a vial, ampule, bottle, syringe, and/or dispenser package, or other suitable container). In some embodiments, provided kits may optionally further include a second container comprising a pharmaceutical excipient for dilution or suspension of an inventive pharmaceutical composition or compound. In some embodiments, the inventive pharmaceutical composition or compound provided in the container and the second container are combined to form one-unit dosage form.

Thus, in one aspect, provided are kits including a first container comprising a compound described herein, or a pharmaceutically acceptable salt, solvate, hydrate, tautomer, or stereoisomer thereof, or a pharmaceutical composition thereof. In certain embodiments, the kit of the disclosure includes a first container comprising a compound described herein, or a pharmaceutically acceptable salt thereof, or a pharmaceutical composition thereof. In certain embodiments, the kits are useful in preventing and/or treating a disease, disorder, or condition described herein in a subject (e.g., a proliferative disease or a non-proliferative disease). In certain embodiments, the kits further include instructions for administering the compound, or a pharmaceutically acceptable salt, solvate, hydrate, tautomer, or stereoisomer thereof, or a pharmaceutical composition thereof, to a subject to prevent and/or treat a proliferative disease or a non-proliferative disease.

Methods of Use

Described herein are compounds useful for modulating splicing. In some embodiments, a compound of Formula (I) may be used to alter the amount, structure, or composition of a nucleic acid (e.g., a precursor RNA, e.g., a pre-mRNA, or the resulting mRNA) by increasing or decreasing splicing at a splice site. In some embodiments, increasing or decreasing splicing results in modulating the level or structure of a gene product (e.g., an RNA or protein) produced. In some embodiments, a compound of Formula (I) may modulate a component of the splicing machinery, e.g., by modulating the interaction with a component of the splicing machinery with another entity (e.g., nucleic acid, protein, or a combination thereof). The splicing machinery as referred to herein comprises one or more spliceosome components. Spliceosome components may comprise, for example, one or more of major spliceosome members (U1, U2, U4, U5, U6 snRNPs), or minor spliceosome members (U11, U12, U4atac, U6atac snRNPs) and their accessory splicing factors.

In another aspect, the present disclosure features a method of modifying of a target (e.g., a precursor RNA, e.g., a pre-mRNA) through inclusion of a splice site in the target, wherein the method comprises providing a compound of Formula (I). In some embodiments, inclusion of a splice site in a target (e.g., a precursor RNA, e.g., a pre-mRNA, or the resulting mRNA) results in addition or deletion of one or more nucleic acids to the target (e.g., a new exon, e.g. a skipped exon). Addition or deletion of one or more nucleic acids to the target may result in an increase in the levels of a gene product (e.g., RNA, e.g., mRNA, or protein).

In another aspect, the present disclosure features a method of modifying a target (e.g., a precursor RNA, e.g., a pre-mRNA, or the resulting mRNA) through exclusion of a splice site in the target, wherein the method comprises providing a compound of Formula (I). In some embodiments, exclusion of a splice site in a target (e.g., a precursor RNA, e.g., a pre-mRNA) results in deletion or addition of one or more nucleic acids from the target (e.g., a skipped exon, e.g. a new exon). Deletion or addition of one or more nucleic acids from the target may result in a decrease in the levels of a gene product (e.g., RNA, e.g., mRNA, or protein). In other embodiments, the methods of modifying a target (e.g., a precursor RNA, e.g., a pre-mRNA, or the resulting mRNA) comprise suppression of splicing at a splice site or enhancement of splicing at a splice site (e.g., by more than about 0.5%, e.g., 1%, 5%, 10%, 15%, 20%, 25%, 30%, 35%, 40%, 45%, 50%, 55%, 60%, 65%, 70%, 75%, 80%, 85%, 90%, 95%, 99%, or more), e.g., as compared to a reference (e.g., the absence of a compound of Formula (I), or in a healthy or diseased cell or tissue).

The methods described herein can be used to modulate splicing, e.g., of a nucleic acid comprising a particular sequence (e.g., a target sequence). Exemplary genes encoding a target sequence (e.g., a target sequence comprising DNA or RNA, e.g., pre-mRNA) include, inter alia, ABCA4, ABCA9, ABCB1, ABCB5, ABCC9, ABCD1, ACADL, ACADM, ACADSB, ACSS2, ACTB, ACTG2, ADA, ADAL, ADAM10, ADAM15, ADAM22, ADAM32, ADAMTS12, ADAMTS13, ADAMTS20, ADAMTS6, ADAMTS9, ADAR, ADCY3, ADCY10, ADCY8, ADNP, ADRBK2, AFP, AGL, AGT, AHCTF1, AHR, AKAP10, AKAP3, AKNA, ALAS1, ALS2CL, ALB, ALDH3A2, ALG6, AMBRA1, ANK3, ANTXR2, ANXA10, ANXA11, ANGPTL3, AP2A2, AP4E1, APC, APOA1, APOB, APOC3, APOH, AR, ARID2, ARID3A, ARID3B, ARFGEF1, ARFGEF2, ARHGAP1, ARHGAP8, ARHGAP18, ARHGAP26, ARHGEF18, ARHGEF2, ARPC3, ARS2, ASHIL, ASHIL-IT1, ASNSD1, ASPM, ATADS, ATF1, ATG4A, ATG16L2, ATM, ATN1, ATP11C, ATP6V1G3, ATP13A5, ATP7A, ATP7B, ATR, ATXN2, ATXN3, ATXN7, ATXN10, AXIN1, B2M, B4GALNT3, BBS4, BCL2, BCL2L1, BCL2-like 11 (BIM), BCL1B, BBOX1, BCS1L, BEAN1, BHLHE40, BMPR2, BMP2K, BPTF, BRAF, BRCA1, BRCA2, BRCC3, BRSK1, BRSK2, BTAF1, BTK, C2orf55, C4orf29, C6orf118, C9orf43, C9orf72, C10orf137, C11orf30, C11orf65, C11orf70, C11orf87, C2orf51, C13orf1, C13orf15, C14orf101, C14orf118, C15orf29, C15orf42, C15orf60, C16orf33, C16orf38, C16orf48, C18orf8, C19orf42, C1 orf107, C1 orf114, C1 orf130, C1orf149, C1orf27, C1orf71, C1orf94, C1R, C20orf74, C21orf70, C3orf23, C4orf18, C5orf34, C8B, C8orf33, C9orf114, C9orf86, C9orf98, C3, CA11, CAB39, CACHD, CACNAA, CACNA1B, CACNA1C, CACNA2D1, CACNA1G, CACNA1H, CALCA, CALCOCO2, CAMK1D, CAMKK1, CAPN3, CAPN9, CAPSL, CARD11, CARKD, CASZ1, CAT, CBLB, CBX1, CBX3, CCDC102B, CCDC11, CCDC15, CCDC18, CCDC5, CCDC81, CCDC131, CCDC146, CD4, CD274, CD1B, CDC14A, CDC16, CDC2L5, CDC42BPB, CDCA8, CDH10, CDH11, CDH24, CDH8, CDH9, CDK5RAP2, CDK6, CDK8, CDK11B, CD33, CD46, CDH1, CDH23, CDK6, CDK11B, CDK13, CEBPZ, CEL, CELSR3, CENPA, CENP1, CENPT, CENTB2, CENTG2, CEP110, CEP170, CEP192, CETP, CFB, CFTR, CFH, CGN, CGNL1, CHAF1A, CHD9, CHIC2, CHL1, CHN1, CHM, CLEC16A, CL1C2, CLCN1, CLINT1, CLK1, CLPB, CLPTM1, CMIP, CMYAS, CNGA3, CNOT1, CNOT7, CNTN6, COG3, COL11A1, COL11A2, COL12A1, COL14A1, COL15A1, COL17A1, COL19A1, COL1A1, COL1A2, COL2A1, COL3A1, COL4A1, COL4A2, COL4A5, COL4A6, COL5A2, COL6A1, COL7A1, COL9A1, COL9A2, COL22A1, COL24A1, COL25A1, COL29A1, COLQ, COMTD1, COPA, COPB2, COPS7B, COPZ2, CPSF2, CPXM2, CR1, CRBN, CRYZ, CREBBP, CRKRS, CSE1L, CSTB, CSTF3, CT45-6, CTNNB1, CUBN, CUL4B, CUL5, CXorf41, CXXC1, CYBB, CYFIP2, CYP3A4, CYP3A43, CYP3A5, CYP4F2, CYP4F3, CYP17, CYP19, CYP24A1, CYP27A1, DAB1, DAZ2, DCBLD1, DCC, DCTN3, DCUNID4, DDA1, DDEF1, DDX1, DDX24, DDX4, DENND2D, DEPDC2, DES, DGAT2, DHFR, DHRS7, DHRS9, DHX8, DIP2A, DMD, DMTF1, DNAH3, DNAH8, DNAI1, DNAJA4, DNAJC13, DNAJC7, DNMT1, DNTTIP2, DOCK4, DOCK5, DOCK10, DOCK11, DOT1L, DPP3, DPP4, DPY19L2P2, DR1, DSCC1, DVL3, DUX4, DYNC1H1, DYSF, E2F1, E2F3, E2F8, E4F1, EBF1, EBF3, ECM2, EDEM3, EFCAB3, EFCAB4B, EFNA4, EFTUD2, EGFR, EIF3A, ELA1, ELA2A, ELF2, ELF3, ELF4, EMCN, EMD, EMLS, ENO3, ENPP3, EP300, EPAS1, EPB41L5, EPHA3, EPHA4, EPHB1, EPHB2, EPHB3, EPS15, ERBB4, ERCC1, ERCC8, ERGIC3, ERMN, ERMP1, ERN1, ERN2, ESR1, ESRRG, ETS2, ETV3, ETV4, ETV5, ETV6, EVC2, EWSR1, EXO1, EXOC4, F3, F11, F13A1, F5, F7, F8, FAH, FAM13A1, FAM13B1, FAM13C1, FAM134A, FAM161A, FAM176B, FAM184A, FAM19A1, FAM20A, FAM23B, FAM65C, FANCA, FANCC, FANCG, FANCM, FANK1, FAR2, FBN1, FBXO15, FBXO18, FBXO38, FCGBP, FECH, FEZ2, FGA, FGD6, FGFR2, FGFR1OP, FGFR1OP2, FGFR2, FGG, FGR, FIX, FKBP3, FLI1, FLJ35848, FLJ36070, FLNA, FN1, FNBP1L, FOLH1, FOSL1, FOSL2, FOXK1, FOXM1, FOXO1, FOXP4, FRAS1, FUT9, FXN, FZD3, FZD6, GAB1, GABPA, GALC, GALNT3, GAPDH, GART, GAS2L3, GATA3, GATAD2A, GBA, GBGT1, GCG, GCGR, GCK, GFI1, GFM1, GH1, GHR, GHV, GJA1, GLA, GLT8D1, GNA11, GNAQ, GNAS, GNB5, GOLGB1, GOLT1A, GOLT1B, GPATCH1, GPR158, GPR160, GPX4, GRAMD3, GRHL1, GRHL2, GRHPR, GRIA1, GRIA3, GRIA4, GRIN2B, GRM3, GRM4, GRN, GSDMB, GSTCD, GSTO2, GTF21, GTPBP4, HADHA, HAND2, HBA2, HBB, HCK, HDAC3, HDACS, HDX, HEPACAM2, HERC1, HES7, HEXA, HEXB, HHEX, HIPK3, HLA-DPB1, HLA-G, HLCS, HLTF, HMBS, HMGA1, HMGCL, HNF1A, HNF1B, HNF4A, HNF4G, HNRNPH1, HOXC10, HP1BP3, HPGD, HPRT1, HPRT2, HSF1, HSF4, HSF2BP, HSPA9, HSPG2, HTT, HXA, ICA1, IDH1, IDS, IFI44L, IKBKAP, IKZF1, IKZF3, IL1R2, ILSRA, IL7RA, IMMT, INPPSD, INSR, INTS3, INTU, IPO4, IP08, IQGAP2, IRF2, IRF4, IRF8, IRX3, ISL1, ISL2, ITFG1, ITGA6, ITGAL, ITGB1, ITGB2, 1TGB3, ITGB4, ITIH1, ITPR2, IWS1, JAK1, JAK2, JAG1, JMJDIC, JPH3, KALRN, KAT6A, KATNAL2, KCNN2, KCNT2, KDM2A, KIAA0256, KIAA0528, KIAA0564, KIAA0586, KIAA1033, KIAA1166, KIAA1219, KIAA1409, KIAA1622, KIAA1787, KIF3B, KIF15, KIF16B, KIF5A, KIFSB, KIF9, KIN, KIR2DL5B, KIR3DL2, KIR3DL3, KIT, KLF3, KLFS, KLF7, KLF10, KLF12, KLF16, KLHL20, KLK12, KLKB1, KMT2A, KMT2B, KPNAS, KRAS, KREMEN1, KRIT1, KRTS, KRTCAP2, KYNU, LICAM, L3MBTL, L3MBTL2, LACE1, LAMA1, LAMA2, LAMA3, LAMB1, LARP7, LDLR, LEF1, LENG1, LGALS3, LGMN, LHCGR, LHX3, LHX6, LIMCH1, LIMK2, LIN28B, LIN54, LMBRD1, LMBRD2, LMLN, LMNA, LMO2, LMO7, LOC389634, LOC390110, LPA, LPCAT2, LPL, LRP4, LRPPRC, LRRK2, LRRC19, LRRC42, LRWD1, LUM, LVRN, LYN, LYST, MADD, MAGI1, MAGT1, MALT1, MAP2K1, MAP4K4, MAPK8IP3, MAPK9, MAPT, MARC1, MARCH5, MATN2, MBD3, MCF2L2, MCM6, MDGA2, MDM4, ASXL1, FUS, SPR54, MECOM, MEF2C, MEF2D, MEGF10, MEGFI1, MEMO1, MET, MGA, MGAM, MGAT4A, MGAT5, MGC16169, MGC34774, MKKS, MIB1, MIER2, MITF, MKL2, MLANA, MLH1, MLLS, MLX, MME, MPDZ, MP1, MRAP2, MRPL11, MRPL39, MRPS28, MRPS35, MS4A13, MSH2, MSH3, MSMB, MST1R, MTDH, MTERF3, MTF1, MTF2, MTIF2, MTHFR, MUC2, MUT, MVK, MYB, MYBL2, MYC, MYCBP2, MYH2, MYRF, MYT1, MYO19, MYO3A, MYO9B, MYOM2, MYOM3, NAG, NARG1, NARG2, NCOA1, NDC80, NDFIP2, NEB, NEDD4, NEK1, NEKS, NEK11, NF1, NF2, NFATC2, NFE2L2, NFIA, NFIB, NFIX, NFKB1, NFKB2, NFKBIL2, NFRKB, NFYA, NFYB, NIPA2, NKAIN2, NKAP, NLRC3, NLRCS, NLRP3, NLRP7, NLRP8, NLRP13, NME1, NME1-NME2, NME2, NME7, NOL10, NOP561, NOS1, NOS2A, NOTCH1, NPAS4, NPM1, NR1D1, NR1H3, NR1H4, NR4A3, NR5A1, NRXN1, NSMAF, NSMCE2, NTSC, NT5C2, NT5C3, NUBP1, NUBPL, NUDTS, NUMA1, NUP88, NUP98, NUP160, NUPL1, OAT, OAZ1, OBFC2A, OBFC2B, OLIG2, OMA1, OPA1, OPN4, OPTN, OSBPLI1, OSBPL8, OSGEPL1, OTC, OTX2, OVOL2, OXT, PA2G4, PADI4, PAH, PAN2, PAOX, PAPOLG, PARD3, PARP1, PARVB, PAWR, PAX3, PAX8, PBGD, PBRM1, PBX2, PCBP4, PCCA, PCGF2, PCNX, PCOTH, PDCD4, PDE4D, PDE8B, PDE10A, PD1A3, PDH1, PDLIMS, PDXK, PDZRN3, PELI2, PDK4, PDSSA, PDSSB, PGK1, PGM2, PHACTR4, PHEX, PHKB, PHLDB2, PHOX2B, PHTF, PIAS1, PIEZO1, PIGF, PIGN, PIGT, PIK3C2G, PIK3CA, PIK3CD, PIK3CG, PIK3R1, PIPSK1A, PITRM1, PIWIL3, PKD1, PKHD1L1, PKD2, PKIB, PKLR, PKM1, PKM2, PLAGL2, PLCB1, PLCB4, PLCG1, PLD1, PLEKHA5, PLEKHA7, PLEKHM1, PLKR, PLXNC1, PMFBP1, POLN, POLR3D, POMT2, POSTN, POU2AF1, POU2F2, POU2F3, PPARA, PPFIA2, PPP1R12A, PPP3CB, PPP4C, PPP4R1L, PPP4R2, PRAME, PRC1, PRDM1, PREX1, PREX2, PRIM1, PRIM2, PRKARIA, PRKCA, PRKG1, PRMT7, PROC, PROCR, PROSC, PRODH, PROX1, PRPF40B, PRPF4B, PRRG2, PRUNE2, PSD3, PSEN1, PSMAL, PTCH1, PTEN, PTK2, PTK2B, PTPN2, PTPN3, PTPN4, PTPN11, PTPN22, PTPRD, PTPRK, PTPRM, PTPRN2, PTPRT, PUS10, PVRL2, PYGM, QRSL1, RABIIFIP2, RAB23, RAF1, RALBP1, RALGDS, RB1CC1, RBL2, RBM39, RBM45, RBPJ, RBSN, REC8, RELB, RFC4, RFT1, RFTN1, RHOA, RHPN2, RIF1, RIT1, RLN3, RMNDSB, RNFI1, RNF32, RNFT1, RNGTT, ROCK1, ROCK2, ROR$^{4}$, RP1, RP6KA3, RP11-265F1, RP13-36C9, RPAP3, RPN1, RPGR, RPL22, RPL22L1, RPS6KA6, RREB1, RRM1, RRP1B, RSK2, RTEL1, RTF1, RUFY1, RUNX1, RUNX2, RXRA, RYR3, SAAL1, SAE1, SALL4, SAT1, SATB2, SBCAD, SCN1A, SCN2A, SCN3A, SCN4A, SCNSA, SCN8A, SCNA, SCN11A, SCO1, SCYL3, SDC1, SDK1, SDK2, SEC24A, SEC24D, SEC31A, SELIL, SENP3, SENP6, SENP7, SERPINA1, SETD3, SETD4, SETDB1, SEZ6, SFRS12, SGCE, SGOL2, SGPL1, SH2DA, SH3BGRL2, SH3PXD2A, SH3PXD2B, SH3RF2, SH3TC2, SHOC2, SIPAIL2, SIPAIL3, SIVA1, SKAP1, SKIV2L2, SLC6A11, SLC6A13, SLC6A6, SLC7A2, SLC12A3, SLC13A1, SLC22A17, SLC25A14, SLC28A3, SLC33A1, SLC35F6, SLC38A1, SLC38A4, SLC39A10, SLC4A2, SLC6A8, SMARCA1, SMARCA2, SMARCA5, SMARCC2, SMCS, SMN2, SMOX, SMS, SMTN, SNCAIP, SNORD86, SNRK, SNRP70, SNX5, SNX6, SOD1, SOD10, SOS, SOS2, SOX5, SOX6, SOX8, SP1, SP2, SP3, SP110, SPAG9, SPATA13, SPATA4, SPATS1, SPECC1L, SPDEF, SP11, SPINKS, SPP2, SPTA1, SRF, SRM, SRP72, SSX3, SSX5, SSX9, STAG1, STAG2, STAMBPL1, STARD6, STAT1, STAT3, STAT5A, STATSB, STAT6, STK17B, STX3, STXBP1, SUCLG2, SULF2, SUPT6H, SUPT16H, SV2C, SYCP2, SYT6, SYCP1, SYTL3, SYTLS, TAF2, TARDBP, TBC1D3G, TBC1D8B, TBC1D26, TBC1D29, TBCEL, TBK1, TBP, TBPL1, TBR1, TBX, TCEB3, TCF3, TCF4, TCF7L2, TCFLS, TCF12, TCP11L2, TDRD3, TEAD1, TEAD3, TEAD4, TECTB, TEK, TERF1, TERF2, TET2, TFAP2A, TFAP2B, TFAP2C, TFAP4, TFDP1, TFRC, TG, TGM7, TGS1, THAP7, THAP12, THOC2, TIAL1, TIAM2, TIMM50, TLK2, TM4SF20, TM6SF1, TMEM27, TMEM77, TMEM156, TMEM194A, TMF1, TMPRSS6, TNFRSFI0A, TNFRSFI0B, TNFRSF8, TNK2, TNKS, TNKS2, TOM1L1, TOM1L2, TOP2B, TP53, TP53INP1, TP53BP2, TP53I3, TP63, TRAF3IP3, TRAPPC2, TRIM44, TRIM65, TRIML1, TRIML2, TRPM3, TRPMS, TRPM7, TRPS1, TSC1, TSC2, TSHB, TSPAN7, TTC17, TTF1, TTLL5, TTLL9, TTN, TTPAL, TTR, TUSC3, TXNDC10, UBE3A, UCKI, UGT1A1, UHRFIBP1, UNC45B, UNCSC, USH2A, USF2, USP1, USP6, USP18, USP38, USP39, UTP20, UTP15, UTP18, UTRN, UTX, UTY, UVRAG, UXT, VAPA, VEGFA, VPS29, VPS35, VPS39, VTIA, VT11B, VWA3B, WDFY2, WDR16, WDR17, WDR26, WDR44, WDR67, WDTC1, WRN, WRNIP1, WT1, WWC3, XBP1, XRN1, XRN2, XX-FW88277, YAP1, YARS, YBX1, YGM, YY1, ZBTB18, ZBTB20, ZC3HAV1, ZC3HC1, ZC3H7A, ZDHHC19, ZEB1, ZEB2, ZFPM1, ZFYVE1, ZFX, ZIC2, ZNF37A, ZNF91, ZNF114, ZNF155, ZNF169, ZNF205, ZNF236, ZNF317, ZNF320, ZNF326, ZNF335, ZNF365, ZNF367, ZNF407, ZNF468, ZNF506, ZNF511, ZNF511-PRAP1, ZNF519, ZNF521, ZNF592, ZNF618, ZNF763, and ZWINT.

Additional exemplary genes encoding a target sequence (e.g., a target sequence comprising DNA or RNA, e.g., pre-mRNA) include genes include A1CF, A4GALT, AAR2, ABAT, ABCA11P, ZNF721, ABCA5, ABHD10, ABHD13, ABHD2, ABHD6, AC000120.3, KRIT1, AC004076.1, ZNF772, AC004076.9, ZNF772, AC004223.3, RAD51D, AC004381.6, AC006486.1, ERF, AC007390.5, AC007780.1, PRKAR1A, AC007998.2, IN080C, AC009070.1, CMC2, AC009879.2, AC009879.3, ADHFE1, AC010487.3, ZNF816-ZNF321P, ZNF816, AC010328.3, AC010522.1, ZNF587B, AC010547.4, ZNF19, AC012313.3, ZNF497, AC012651.1, CAPN3, AC013489.1, DET1, AC016747.4, C2orf74, AC020907.6, FXYD3, AC021087.5, PDCD6, AHRR, AC022137.3, ZNF761, AC025283.3, NAA60, AC027644.4, RABGEF1, AC055811.2, FLCN, AC069368.3, ANKDD1A, AC073610.3, ARF3, AC074091.1, GPN1, AC079447.1, LIPT1, AC092587.1, AC079594.2, TRIM59, AC091060.1, C18orf21, AC092143.3, MC1R, AC093227.2, ZNF607, AC093512.2, ALDOA, AC098588.1, ANAPC10, AC107871.1, CALML4, AC114490.2, ZMYM6, AC138649.1, NIPA1, AC138894.1, CLN3, AC139768.1, AC242426.2, CHD1L, ACADM, ACAP3, ACKR2, RP11-141M3.5, KRBOX1, ACMSD, ACOT9, ACPS, ACPL2, ACSBG1, ACSF2, ACSF3, ACSL1, ACSL3, ACVR1, ADAL, ADAM29, ADAMTS10, ADAMTSLS, ADARB1, ADAT2, ADCK3, ADD3, ADGRG1, ADGRG2, ADH1B, ADIPOR1, ADNP, ADPRH, AGBLS, AGPAT1, AGPAT3, AGR2, AGTR1, AHDC1, AHI1, AHNAK, AIFM1, AIFM3, AIMP2, AK4, AKAP1, AKNAD1, CLCC1, AKR1A1, AKT1, AKT1S1, AKT2, AL139011.2, PEX19, AL157935.2, ST6GALNAC6, AL358113.1, TJP2, AL441992.2, KYAT1, AL449266.1, CLCC1, AL590556.3, LINC00339, CDC42, ALAS1, ALB, ALDH16A1, ALDHIB1, ALDH3A1, ALDH3B2, ALDOA, ALKBH2, ALPL, AMD1, AMICA1, AMN1, AMOTL2, AMY1B, AMY2B, ANAPC10, ANAPC11, ANAPC15, ANG, RNASE4, AL163636.2, ANGEL2, ANGPTL1, ANKMY1, ANKRDI1, ANKRD28, ANKRD46, ANKRD9, ANKS3, ANKS3, RP11-127I20.7, ANKS6, ANKZF1, ANPEP, ANXA11, ANXA2, ANXA8L2, AL603965.1, AOC3, AP000304.12, CRYZL1, AP000311.1, CRYZL1, AP000893.2, RAB30, AP001267.5, ATP5MG, AP002495.2, AP003175.1, OR2AT4, AP003419.1, CLCF1, AP005263.1, ANKRD12, AP006621.5, AP006621.1, AP1G1, AP3M1, AP3M2, APBA2, APBB1, APLP2, APOA2, APOL1, APOL3, APTX, ARAP1, STARD10, ARF4, ARFIP1, ARFIP2, ARFRP1, ARHGAPIIA, ARHGAP33, ARHGAP4, ARHGEF10, ARHGEF3, ARHGEF35, OR2A1-AS1, ARHGEF35, OR2A1-AS1, ARHGEF34P, ARID1B, ARHGEF35, OR2A20P, OR2A1-AS1, ARHGEF9, ARL1, ARL13B, ARL16, ARL6, ARMC6, ARMC8, ARMCX2, ARMCX5, RP4-769N13.6, ARMCX5-GPRASP2, BHLHB9, ARMCX5-GPRASP2, GPRASP1, ARMCX5-GPRASP2, GPRASP2, ARMCX6, ARNT2, ARPP19, ARRB2, ARSA, ART3, ASB3, GPR75-ASB3, ASCC2, ASNS, ASNS, AC079781.5, ASPSCR1, ASS1, ASUN, ATE1, ATF1, ATF7IP2, ATG13, ATG4D, ATG7, ATG9A, ATM, ATOX1, ATP1B3, ATP2C1, ATP5F1 A, ATP5G2, ATPSJ, ATPSMD, ATPSPF, ATP6AP2, ATP6VOB, ATP6ViC1, ATP6V1D, ATP7B, ATXN1, ATXN1L, IST1, ATXN3, ATXN7L1, AURKA, AURKB, AXDND1, B3GALNT1, B3GALT5, AF064860.1, B3GALT5, AF064860.5, B3GNT5, B4GALT3, B4GALT4, B9D1, BACH1, BAIAP2, BANF1, BANF2, BAX, BAZ2A, BBIP1, BCHE, BCL2L14, BCL6, BCL9L, BCS1L, BDH1, BDKRB2, AL355102.2, BEST1, BEST3, BEX4, BHLHB9, BID, BIN3, BIRC2, BIVM, BIVM-ERCCS, BIVM, BLCAP, BLK, BLOCIS1, RP11-644F5.10, BLOCIS6, AC090527.2, BLOC1S6, RP11-96020.4, BLVRA, BMF, BOLA1, BORCS8-MEF2B, BORCS8, BRCA1, BRD1, BRDT, BRINP3, BROX, BTBD10, BTBD3, BTBD9, BTD, BTF3L4, BTNL9, BUB1B-PAK6, PAK6, BUB3, C10orf68, C11orf1, C11orf48, C11orf54, C11orf54, AP001273.2, C11orf57, C11orf63, C11orf82, C12orf23, C12orf4, C12orf65, C12orf79, C14orf159, C14orf93, C17orf62, C18orj21, C19orf12, C19orf40, C19orf47, C19orf48, C19orf54, CID, C1GALT, C1 QB, C1QTNF, CIS, C1orf101, C1orf112, C1orf116, C1orf159, C1orf63, C2, C2, CFB, C20orf27, C21 orf58, C2CD4D, C2orf15, LIPT1, MRPL30, C2orf80, C2orf81, C3orf14, C3orf17, C3orf18, C3orf22, C3orf33, AC04472.3, C4orf33, C5orf28, C5orf34, C6orf118, C6orf203, C6orf211, C6orf48, C7orf50, C7orf55, C7orf55-LUC7L2, LUC7L2, C8orf44-SGK3, C8orf44, C8orf59, C9, DAB2, C9orf153, C9orf9, CA5BP1, CA5B, CABYR, CALCA, CALCOCO1, CALCOCO2, CALM1, CALM3, CALML4, RP11-315D16.2, CALN, CALU, CANT1, CANX, CAP1, CAPN12, CAPS2, CARD8, CAR-HSP1, CARNS1, CASC1, CASP3, CASP7, CBFA2T2, CBS, CBY1, CCBL1, CCBL2, RBMXL1, CCDC12, CCDC126, CCDC14, CCDC149, CCDC150, CCDC169-SOHLH2, CCDC169, CCDC171, CCDC37, CCDC41, CCDC57, CCDC63, CCDC7, CCDC74B, CCDC77, CCDC82, CCDC90B, CCDC91, CCDC92, CCNE1, CCHCR1, CCL28, CCNBIIP1, CCNC, CCND3, CCNG1, CCP110, CCR9, CCT7, CCT8, CD151, CD1D, CD200, CD22, CD226, CD276, CD36, CD59, CDC26, CDC42, CDC42SE1, CDC42SE2, CDHR3, CDK10, CDK16, CDK4, CDKAL1, CDKL3, CTD-2410N18.4, CDKN1A, CDKN2A, CDNF, CEBPZOS, CELF1, CEMIP, CENPK, CEP170B, CEP250, CEP57, CEP57L1, CEP63, CERS4, CFL1, CFL2, CFLAR, CGNL1, CHCHD7, CHDIL, CHD8, CHFR, ZNF605, CHIA, CHID1, CHL1, CHM, CHMPIA, CHMP3, RNF103-CHMP3, CHRNA2, CIDEC, CIRBP, CITED1, CKLF-CMTM1, CMTM1, CKMTIB, CLDN12, CTB-13L3.1, CLDND1, AC021660.3, CLDND1, CPOX, CLHC1, CLIP1, CLUL1, CMC4, MTCP1, CNDP2, CNFN, CNOT1, CNOT6, CNOT7, CNOT8, CNR1, CNR2, CNTFR, CNTRL, COA1, COASY, COCH, COL8A1, COLCA1, COLEC11, COMMD3-BMI1, BMI1, COPSS, COPS7B, COQ8A, COR06, COTL1, COX14, RP4-60503.4, COX7A2, COX7A2L, COX7B2, CPA4, CPAS, CPEB1, CPNE1, AL109827.1, RBM12, CPNE1, RP1-

309K20.6, RBM12, CPNE3, CPSF3L, CPT1C, CREB3L2, CREM, CRP, CRYZ, CS, AC073896.1, CS, RP11-977G19.10, CSAD, CSDE1, CSF2RA, CSGALNACT1, CSK, CSNK2A1, CSRNP2, CT45A4, CT45A4, CT45A5, CT45A6, CTBP2, CTCFL, CTD-2116N17.1, KIAA0101, CTD-2349B8.1, SYT17, CTD-2528L19.4, ZNF607, CTD-2619J13.8, ZNF497, CTNNA1, CTNNBIP1, CTNND1, CTPS2, CTSB, CTSL, CTTN, CUL2, CUL9, CWC15, CXorf40B, CYB561A3, CYBC1, CYLD, CYP11A1, CYP2R1, CYP4B1, CYP4F22, DAG1, DAGLB, KDELR2, DARS, DBNL, DCAF11, DCAF8, PEX19, DCLRE1C, DCTD, DCTN1, DCTN4, DCUNID2, DDR1, DDX11, DDX19B, AC012184.2, DDX19B, RP1-529KL.3, DDX25, DDX39B, ATP6V1G2-DDX39B, SNORD84, DDX42, DDX60L, DEDD, DEDD2, DEFA1, DEFA1B, DEFA1B, DEFA3, DENND1C, DENND2A, DENND4B, DET1, DGKA, DGKZ, DGLUCY, DHRS4L2, DHRS9, DHX40, DIABLO, AC048338.1, DIAPH1, DICER1, DKKL1, DLG1, DLG3, DLST, DMC1, DMKN, DMTF1, DMTN, DNAJC14, DNAJC19, DNAL1, DNASE1L1, DNMT3A, DOC2A, DOCK8, DOK1, DOPEY1, DPAGT1, DPP8, DRAM2, DRD2, DROSHA, DSN1, DTNA, DTX2, DTX3, DUOX1, DUOXA1, DUS2, DUSP10, DUSP13, DUSP18, DUSP22, DYDC1, DYDC2, DYNLL1, DYNLT1, DYRK1A, DYRK2, DYRK4, RP11-500M8.7, DZIP1L, E2F6, ECHDC1, ECSIT, ECT2, EDC3, EDEM1, EDEM2, MMP24-AS1, RP4-61404.11, EEF1AKNMT, EEF1D, EFEMP1, EFHC1, EGFL7, EHF, EI24, EIFIAD, EIF2B5, EIF4G1, EIF2B5, POLR2H, EIF3E, EIF3K, EIF4E3, EIF4G1, ELF1, ELMO2, ELMOD1, AP000889.3, ELMOD3, ELOC, ELOF1, ELOVL1, ELOVL7, ELP1, ELP6, EML3, EMP3, ENC1, ENDOV, ENO1, ENPPS, ENTHD2, ENTPD6, EP400NL, EPB41L1, EPDR1, NME8, EPHX1, EPM2A, EPN1, EPN2, EPN3, EPS8L2, ERBB3, ERC1, ERCC1, ERG, ERI2, ERI2, DCUNID3, ERLIN2, ERMARD, ERRFI1, ESR2, RP11-544I20.2, ESRRA, ESRRB, ESRRG, ETFA, ETFRF1, ETV1, ETV4, ETV7, EVAIA, EVC2, EVX1, EXD2, EXOS, EXOC1, EXOC2, FAAP24, FABP6, FADS1, FADS2, FAHD2B, FAM107B, FAM111A, FAM111B, FAM114A1, FAM114A2, FAM115C, FAM115C, FAM115D, FAM120B, FAM133B, FAM135A, FAM153A, FAM153B, FAM154B, FAM156A, FAM156B, FAM168B, FAM172A, FAM182B, FAM192A, FAM19A2, FAM200B, FAM220A, FAM220A, AC009412.1, FAM222B, FAM227B, FAM234A, AC004754.1, FAM3C, FAM45A, FAM49B, FAM60A, FAM63A, FAM81A, FAM86B1, FAM86B2, FANC1, FANK1, FAR2, FAXC, FAXDC2, FBF1, FBH1, FBXL4, FBXO18, FBXO22, FBXO31, FBXO41, FBXO44, FBXO45, FBXW9, FCHO1, FCHSD2, FDFT1, FDPS, FER, FETUB, FGD4, FGF1, FGFR1, FGFRL1, FGL1, FHL2, FIBCD1, FIGNL1, FIGNL1, DDC, FKBPS, FKRP, FLRT2, FLRT3, FMC1, LUC7L2, FMC1-LUC7L2, FNDC3B, FOLH1, FOLR1, FOXP1, FOXK1, FOXM1, FOXO1, FOXP4, AC097634.4, FOXRED1, FPR1, FPR2, FRG1B, FRS2, FTO, FTSJ1, FUK, FUT10, FUT3, FUT6, FXYD3, FZD3, G2E3, GAA, GABARAPL1, GABPB1, GABRAS, GAL3ST1, GALE, GALNT11, GALNT14, GALNT6, GAPVD1, GARNL3, GAS2L3, GAS8, GATA1, GATA2, GATA4, GBA, GCNT1, GDPD2, GDPDS, GEMIN7, MARK4, GEMIN8, GGA3, GGACT, AL356966.1, GGPS1, GHRL, GID8, GIGYF2, GIMAP8, GIPC1, GJB1, GJB6, GLB1L, GLI1, GLT8D1, GMFG, GMPR2, GNAI2, GNAQ, GNB1, GNB2, GNE, GNG2, GNGT2, GNPDA1, GNPDA2, GOLGA3, CHFR, GOLGA4, GOLPH3L, GOLT1B, GPBP1L1, GPER1, GPR116, GPR141, EPDR1, GPR155, GPR161, GPR56, GPR63, GPR75-ASB3, ASB3, GPR85, GPSM2, GRAMD1B, GRB10, GRB7, GREM2, GRIA2, GSDMB, GSE1, GSN, GSTA4, GSTZ1, GTDC1, GTF2H1, GTF2H4, VARS2, GTF3C2, GUCYIA3, GUCYIB3, GUK1, GULP1, GYPC, GYS1, GZF1, HAGH, HAO2, HAPLN3, HAVCR1, HAX1, HBG2, AC104389.4, HBG2, AC104389.4, HBE1, HBG2, AC104389.4, HBE1, OR51B5, HBG2, HBE1, AC104389.28, HBS1L, HCFC1R1, HCK, HDAC2, HDAC6, HDAC7, HDLBP, HEATR4, HECTD4, HEXIM2, HHAT, HHATL, CCDC13, HINFP, HIRA, C22orf39, HIVEP3, HJV, HKR1, HLF, HMBOX1, HMGA1, HMGB3, HMGCR, HMGN4, HMOX2, HNRNPC, HNRNPD, HNRNPH1, HNRNPH3, HNRNPR, HOMER3, HOPX, HOXA3, HOXB3, HOXB3, HOXB4, HOXC4, HOXD3, HOXD3, HOXD4, HPCAL1, HPS4, HPS5, HRH1, HS3ST3A1, HSH2D, HSP90AA1, HSPD1, HTT, HUWE1, HYOU1, IAH1, ICA1L, ICAM2, ICE2, ICK, IDH2, IDH3G, IDS, IFI27, IFI44, IFT20, IFT22, IFT88, IGF2, INS-IGF2, IGF2BP3, IGFBP6, IKBKAP, IKBKB, ILI1, IL18BP, IL18RAP, ILIRAP, ILIRL1, IL18R1, IL1RN, IL32, IL4I1, NUP62, AC011452.1, IL4I1, NUP62, CTC-326K19.6, IL6ST, ILVBL, IMMPIL, IMPDH1, INCA1, ING1, INIP, INPP1, INPPSJ, INPPSK, INSIG2, INTSI1, INTS12, INTS14, IP6K2, IP6K3, IPOI1, LRRC70, IQCE, IQGAP3, IRAK4, IRF3, IRF5, IRF6, ISG20, IST1, ISYNA1, ITFG2, ITGBIBP1, ITGB7, ITIH4, RP5-966M1.6, ITPRIPL1, JADE1, JAK2, JARID2, JDP2, KANK1, KANK1, RP11-31F19.1, KANK2, KANSLIL, KAT6A, KBTBD2, KBTBD3, KCNAB2, KCNE3, KCNG1, KCNJ16, KCNJ9, KCNMB2, AC117457.1, LINC01014, KCTD20, KCTD7, RABGEF1, KDM1B, KDM4A, AL451062.3, KHNYN, KIAA0040, KIAA0125, KIAA0196, KIAA0226L, PPP1R2P4, KIAA0391, KIAA0391, AL121594.1, KIAA0391, PSMA6, KIAA0753, KIAA0895, KIAA0895L, KIAA1191, KIAA1407, KIAA1841, C2orf74, KIF12, KIF14, KIF27, KIF9, KIFC3, KIN, KIRREL1, KITLG, KLC1, APOPT1, AL139300.1, KLC4, KLHDC4, KLHDC8A, KLHL13, KLHL18, KLHL2, KLHL24, KLHL7, KLKI1, KLK2, KLKS, KLK6, KLK7, KNOP1, KRBA2, AC135178.2, KRBA2, RP11-849F2.7, KRIT1, KRT15, KRT8, KTN1, KXD1, KYAT3, RBMXL1, KYNU, L3MBTL1, LACC1, LARGE, LARP4, LARP7, LAT2, LBHD1, LCA5, LCASL, LCTL, LEP-ROTL1, LGALS8, LGALS9C, LGMN, LHFPL2, LIG4, LIMCH1, LIMK2, LIMS2, LINC00921, ZNF263, LIPF, LLGL2, LMAN2L, LMCD1, LMF1, RP11-161M6.2, LMO1, LMO3, LOXHD1, LPAR1, LPAR2, LPAR4, LPARS, LPAR6, LPHN1, LPIN2, LPIN3, LPP, LRFNS, LRIF1, LRMP, LRRC14, LRRC20, LRRC24, C8orf82, LRRC39, LRRC42, LRRC48, LRRC4C, LRRC8A, LRRC8B, LRRD1, LRTOMT, LRTOMT, AP000812.5, LSM7, LTB4R, LTBP3, LUC7L2, FMC1-LUC7L2, LUC7L3, LUZP1, LYG1, LYL1, LYPD4, LYPD6B, LYRM1, LYRMS, LYSMD4, MACC1, MAD1L1, MAD1L1, AC069288.1, MAEA, MAFF, MAFG, MAFK, MAGEA12, CSAG4, MAGEA2, MAGEA2B, MAGEA4, MAGEB1, MAGOHB, MAN2A2, MANBAL, MAOB, MAP2K3, MAP3K7CL, MAP3K8, MAP7, MAP9, MAPK6, MAPK7, MAPK8, MAPKAP1, 10-Mar, 7-Mar, 8-Mar, MARK2, MASP1, MATK, MATR3, MATR3, SNHG4, MB, MBDS, MBNL1, MBOAT7, MCC, MCFD2, MCM9, MCOLN3, MCRS1, MDC1, MDGA2, MDH2, MDM2, ME1, MEAK7, MECR, MED4, MEF2A, MEF2B, BORCS8-MEF2B, MEF2BNB-MEF2B, MEF2B, MEF2BNB, MEF2C, MEF2D, MEGF10, ME11, MEIS2, MELK, MET, METTL13, METTL23, MFF, MFN2, MFSD2A, MGST3, MIB2, MICAL1, MICAL3, MICOS10, NBL1, MICOS10-NBL1, MID1, MINA, MINOS1-NBL1, MINOS1, MIOS, MIPOL1, MIS12, MKLN1, MKNK1, MKNK1, MOB3C, MLF2, MLH1, MMP17, MOBP, MOCS1, MOGS, MOK, MORF4L1, MPC1, MPC2, MPG, MP1, MPP1, MPP2, MPPE1, MPST, MRAS, MRO, MROH1, MROH7-TTC4, MROH7, MRPL14, MRPL24, MRPL33, BABAM2, MRPL33, BRE, MRPL47, MRPL48, MRPL55, MRRF, MRTFA, MRTFB, MRVI1, MS4A1, MS4A15, MS4A3, MS4A6E, MS4A7, MS4A14, MSANTD3, MSANTD4, MSH5, MSH5-SAPCD1, MSL2, MSRB3, MSS51, MTCP1, CMC4, MTERF, MTERF1, MTERF3, MTERFD2, MTERFD3, MTF2, MTG2, MTHFD2, MTHFD2L, MTIF2, MTIF3, MTMR10, MTRF1, MTRR, MTUS2, MUTYH, MVK, MX1, MX2, MYH10, MYL12A, MYB, MYD88, MYL5, MYLIP, MYNN, MYO15A, MYO1B, MYOM2, MZF, N4BP2L2, NAA60, NAB1, NAE, NAGK, NAP1L1, NAPIL4, NAPG, NARFL, NARG2, NAT1, NAT10, NBPF11, WI2-3658N16.1, NBPF12, NBPF15, NBPF24, NBPF6, NBPF9, NBR1, NCAPG2, NCBP2, NCEH1, NCOA1, NCOA4, NDC1, NDRG1, NDRG2, NDRG4, NDST1, NDUFAF6, NDUFB2, NDUFC1, NDUFS1, NDUFS8, NDUFV1, NEDD1, NEIL1, NEIL2, NEK10, NEK11, NEK6, NEK9, NELFA, NEU4, NFATS, NFE2, NFE2L2, AC019080.1, NFRKB, NFYA, NFYC, NIF3L1, NIPA2, NKIRAS1, NKX2-1, NLRC3, NME1, NME1-NME2, NME2, NME1-NME2, NME2, NME4, NME6, NME9, NOD1, NOL10, NOL8, NONO, NPAS1, NPIPA8, RP11-1212A22.1, NPIPB3, NPIPB4, NPIPB9, NPL, NPM1, NPPA, NQO2, NR1H3, NR2C2, NR2F2, NR4A1, NRDC, NREP, NRF, NRG4, NRIP1, NSD2, NSDHL, NSG1, NSMCE2, NSRP1, NT5C2, NTF4, NTMT1, NTNG2, NUBP2, NUCB2, NUDT1, NUDT2, NUDT4, NUF2, NUMBL, NUP50, NUP54, NUP85, NVL, NXF1, NXPE1, NXPE3, OARD1, OAT, OAZ2, OCIAD1, OCLN, ODF2, OGDHL, OGFOD2, AC026362.1, OGFOD2, RP11-197N18.2, OLA1, OPRL1, OPTN, OR2H1, ORAI2, ORMDL1, ORMDL2, ORMDL3, OSBPL2, OSBPL3, OSBPLS, OSBPL9, OSER1, OSGIN1, OSR2, P2RX4, P2RY2, P2RY6, P4HA2, PABPC1, PACRGL, PACSIN3, PADI1, PAIP2, PAK1, PAK3, PAK4, PAK7, PALB2, PANK2, PAQR6, PARP11, PARVG, PASK, PAX6, PBRM1, PBXIP1, PCBP3, PCBP4, AC115284.1, PCBP4, RP11-155D18.14, RP11-155D18.12, PCGF3, PCGFS, PCNP, PCSK9, PDCD10, PDCD6, AHRR, PDDC1, PDGFRB, PDIA6, PDIK1L, PDLIM7, PDP1, PDPK1, PDPN, PDZD11, PEA15, PEX2, PEX5, PEXSL, PFKM, PFN4, PGAP2, PGAP2, AC090587.2, PGAP3, PGM3, PGPEP1, PHB, PHC2, PHF20, PHF21A, PHF23, PHKB, PHLDB1, PHOSPHO1, PHOSPHO2, KLHL23, PI4 KB, PIAS2, PICALM, PIF1, PIGN, PIGO, PIGT, PIK3CD, PILRB, STAG3L5P-PVRIG2P-PILRB, PIPSKIB, PIR, PISD, PIWIL4, FUT4, PKD2, PKIA, PKIG, PKM, PKN2, PLAlA, PLA2G2A, PLA2G5, PLA2G7, PLAC8, PLAGL1, PLD1, PLD3, PLEKHA1, PLEKHA2, PLEKHA6, PLEKHGS, PLIN1, PLS1, PLS3, PLSCR1, PLSCR2, PLSCR4, PLXNB1, PLXNB2, PMP22, PMS1, PNISR, PNKP, AKTIS1, PNMT, PNPLA4, PNPLA8, PNPO, PNRC1, POCiB, POFUT1, POLB, POLD1, POLH, POL1, POLL, POLRIB, POM121, POM121C, AC006014.7, POM121C, AC211429.1, POMC, POMT1, POP1, PORCN, POUSF1, PSORS1C3, PPARD, PPARG, PPHLN1, PPIL3, PPIL4, PPM1A, PPMIB, AC013717.1, PPP1CB, PPP1R11, PPP1R13L, PPP1R26, PPP1R9A, PPP2R2B, PPP3CA, PPP6R1, PPP6R3, PPT2, PPT2-EGFL8, EGFL8, PPWD1, PRDM2, PRDM8, PRELID3A, PREPL, PRICKLE1, PRKAG1, PRMT2, PRMTS, PRMT7, PROM1, PRPS1, PRPSAP2, PRR14L, PRR15L, PRR5, PRRS-ARHGAP8, PRRSL, PRR7, PRRC2B, PRRT4, PRSS50, PRSS45, PRSS44, PRUNE, PRUNE1, PSEN1, PSMA2, PSMF1, PSORS1C1, PSPH, PSRC1, PTBP3, PTHLH, PTK2, PTPDC1, PTPRM, PUF60, PUM2, PUS1, PUS10, PXN, PXYLP1, PYCR1, QRICH1, R3HCC1L, R3HDM2, RAB17, RAB23, RAB3A, RAB3D, TMEM205, RAB4B-EGLN2, EGLN2, AC008537.1, RAB5B, RAB7L1, RABL2A, RABL2B, RABL5, RACGAP1, RAD17, RAD51L3-RFFL, RAD51D, RAD52, RAE1, RAI14, RAI2, RALBP1, RAN, RANGAP1, RAP1A, RAPiB, RAP1GAP, RAPGEF4, RAPGEFL1, RASGRP2, RASSF1, RBCK1, RBM12B, RBM14, RBM4, RBM14-RBM4, RBM23, RBM4, RBM14-RBM4, RBM47, RBM7, AP002373.1, RBM7, RP11-212D19.4, RBMS2, RBMY1E, RBPJ, RBPMS, RBSN, RCBTB2, RCC1, RCC1, SNHG3, RCCD1, RECQL, RELL2, REPIN1, AC073111.3, REPIN1, ZNF775, RER1, RERE, RFWD3, RFX3, RGL2, RGMB, RGS11, RGS3, RGS5, AL592435.1, RHBDD1, RHNO1, TULP3, RHOC, AL603832.3, RHOC, RP11-426L16.10, RHOH, RIC8B, RIMKLB, RIN1, RIPK2, RIT1, RLIM, RNASE4, ANG, AL163636.6, RNASEK, RNASEK-C17orf49, RNF111, RNF123, RNF13, RNF14, RNF185, RNF216, RNF24, RNF32, RNF34, RNF38, RNF4, RNF44, RNH1, RNMT, RNPS1, RO60, ROPN1, ROPN1B, ROR2, RP1-102H19.8, C6orf163, RP1-283E3.8, CDK11A, RP11-120M18.2, PRKAR1A, RP11-133K10.2, PAK6, RP11-164J13.1, CAPN3, RP11-21J18.1, ANKRD12, RP11-322E11.6, INO80C, RP1-337C18.10, CHD1L, RP11-432B6.3, TRIM59, RP11-468E2.4, IRF9, RP11-484M3.5, UPK1B, RP11-517H2.6, CCR6, RP11-613M10.9, SLC25A51, RP11-659G9.3, RAB30, RP11-691N7.6, CTNND1, RP11-849H4.2, RP11-896J10.3, NKX2-1, RP11-96020.4, SQRDL, RP1-986E7.7, SERPINA3, RP4-769N13.6, GPRASP1, RP4-769N13.6, GPRASP2, RP4-798P15.3, SEC16B, RP5-1021I20.4, ZNF410, RP6-109B7.3, FLJ27365, RPE, RPH3AL, RPL15, RPL17, RPL17-C18orf32, RPL17, RPL23A, RPL36, HSD11B1L, RPP38, RPS20, RPS27A, RPS3A, RPS6KA3, RPS6KC1, RPS6KL1, RPUSD1, RRAGD, RRAS2, RRBP1, RSLiD1, RSRC2, RSRP1, RUBCNL, RUNXIT1, RUVBL2, RWDD1, RWDD4, S100A13, AL162258.1, S100A13, RP1-178F15.5, S100A16, S100A4, S100A3, S100A6, S100PBP, SAA1, SACM1L, SAMD4B, SAR1A, SARAF, SARNP, RP11-762I7.5, SCAMPS, SCAP, SCAPER, SCFD1, SCGB3A2, SCIN, SCML1, SCNNID, SC02, SCOC, SCRN1, SDC2, SDC4, SECi3, SECi4L1, SECi4L2, SEC22C, SEC23B, SEC24C, SEC61G, SEMA4A, SEMA4C, SEMA4D, SEMA6C, SENP7, SEPP1, ii-Sep, 2-Sep, SERGEF, AC055860.1, SERP1, SERPINA1, SER-PINAS, SERPINB6, SERPING1, SERPINH1, SERTAD3, SETD5, SFMBT1, AC096887.1, SFTPA1, SFTPA2, SFXN2, SGCD, SGCE, SGK3, SGK3, C8orf44, SH2B1, SH2D6, SH3BP1, Z83844.3, SH3BP2, SH3BP5, SH3D19, SH3YL1, SHC1, SHISAS, SHMT1, SHMT2, SHOC2, SHROOM1, SIGLEC5, SIGLEC14, SIL1, SIN3A, SIRT2, SIRT6, SKP1, STAT4, AC104109.3, SLAIN1, SLC10A3, SLC12A9, SLC14A1, SLC16A6, SLC1A2, SLC1A6, SLC20A2, SLC25A18, SLC25A19, SLC25A22, SLC25A25, SLC25A29, SLC25A30, SLC25A32, SLC25A39, SLC25A44, SLC25A45, SLC25A53, SLC26A11, SLC26A4, SLC28A1, SLC29A1, SLC2A14, SLC2A5, SLC2A8, SLC35B2, SLC35B3, SLC35C2, SLC37A1, SLC38A1, SLC38A11, SLC39A13, SLC39A14, SLC41A3, SLC44A3, SLC4A7, SLC4A8, SLC5A10, SLC5A11, SLC6A1, SLC6A12, SLC6A9, SLC7A2, SLC7A6, SLC7A7, SLCO1A2, SLCO1C1, SLCO2B1, SLFN11, SLFN12, SLFNL1, SLMO1, SLTM, SLU7, SMAD2, SMAP2, SMARCA2, SMARCE1, AC073508.2, SMARCE1, KRT222, SMC6, SMG7, SMIM22, SMOX, SMPDL3A, SMTN, SMU1, SMUG1, SNAP25, SNCA, SNRK, SNRPC, SNRPD1, SNRPD2, SNRPN, SNRPN, SNURF, SNUPN, SNX11, SNX16, SNX17, SOAT1, SOHLH2, CCDC169-SOHLH2, CCDC169, SORBS1, SORBS2, SOX5, SP2, SPART, SPATA20, SPATA21, SPATS2, SPATS2L, SPDYE2, SPECC1, SPECC1L, SPECC1L-ADORA2A, SPECC1L-ADORA2A, ADORA2A, SPEG, SPG20, SPG21, SPIDR, SPIN1, SPOCD1, SPOP, SPRR2A, SPRR2B, SPRR2E, SPRR2B, SPRR2F, SPRR2D, SPRR3, SPRYi, SPRY4, SPTBN2, SRC, SRGAP1, SRP68, SRSF11, SSX1, SSX2IP, ST3GAL4, ST3GAL6, STS, ST6GALNAC6, ST7L, STAC3, STAG1, STAG2, STAMBP, STAMBPL1, STARD3NL, STAT6, STAU1, STAU2, AC022826.2, STAU2, RP11-463D19.2, STEAP2, STEAP3, ST1L, STK25, STK33, STK38L, STK40, STMN1, STON1, STON1-GTF2AiL, STRAP, STRBP, STRC, AC011330.5, STRC, CATSPER2, STRC, CATSPER2, AC011330.5, STRC, STRCP1, STT3A, STX16-NPEPL1, NPEPL1, STX5, STX6, STX8, STXBP6, STYK1, SULTIA1, SUL-TIA2, SUMF2, SUN, SUN2, SUN2, DNAL4, SUOX, SUPT6H, SUV39H2, SV2B, SYBU, SYNCR1P, SYNJ2, SYT1, SYTL4, TAB2, TACC1, TADA2B, TAFiC, TAF6, AC073842.2, TAF6, RP11-506M12.1, TAF9, TAGLN, TANK, TAPSAR1, PSMB9, TAPT1, TATDN1, TAZ, TBC1D1, TBC1D12, HELLS, TBC1D15, TBCID3H, TBCID3G, TBC1D5, TBC1D5, SATB1, TBCA, TBCEL, TBCEL, AP000646.1, TBL1XR1, TBP, TBX5, TBXAS1, TCAF1, TCEA2, TCEAL4, TCEAL8, TCEAL9, TCEANC, TCEB1, TCF19, TCF25, TCF4, TCP1, TCP10L, AP000275.65, TCP11, TCP11L2, TCTN1, TDG, TDP1, TDRD7, TEAD2, TECR, TENC1, TENT4A, TEX264, TEX30, TEX37, TFDP1, TFDP2, TFEB, TFG, TFP1, TF, TFP1, TGIF1, THAP6, THBS3, THOCS, THRAP3, THUMPD3, TIAL1, TIMM9, TIMP1, TIRAP, TJAP1, TJP2, TK2, TLDC1, TLE3, TLE6, TLN1, TLR10, TM9SF1, TMBIM1, TMBIM4, TMBIM6, TMC6, TMCC1, TMCO4, TMEM126A, TMEM139, TMEM150B, TMEM155, TMEM161B, TMEM164, TMEM168, TMEM169, TMEM175, TMEM176B, TMEM182, TMEM199, CTB-96E2.3, TMEM216, TMEM218, TMEM230, TMEM263, TMEM45A, TMEM45B, TMEM62, TMEM63B, TMEM66, TMEM68, TMEM98, TMEM9B, TMPRSSIID, TMPRSSS, TMSB15B, TMTC4, TMUB2, TMX2-CTNND1, RP11-691N7.6, CTNND1, TNFAIP2, TNFAIP8L2, SCNM1, TNFRSFIOC, TNFRSF19, TNFRSF8, TNFSF12-TNFSF13, TNFSF12, TNFSF13, TNFSF12-TNFSF13, TNFSF13, TNIP1, TNK2, TNNT1, TNRC18, TNS3, TOB2, TOM1L, TOP1MT, TOP3B, TOX2, TP53, RP11-199F1.2, TP53I1, TP53INP2, TPCN1, TPM3P9, AC022137.3, TPT1, TRA2B, TRAF2, TRAF3, TRAPPC12, TRAPPC3, TREH, TREX1, TREX2, TRIB2, TRIM3, TRIM36, TRIM39, TRIM46, TRIM6, TRIM6-TRIM34, TRIM6-TRIM34, TRIM34, TRIM66, TRIM73, TRIT1, TRMTIOB, TRMT2B, TRMT2B-AS1, TRNT1, TRO, TROVE2, TRPS1, TRPT1, TSC2, TSGA10, TSPAN14, TSPAN3, TSPAN4, TSPAN5, TSPAN6, TSPAN9, TSPO, TTC12, TTC23, TTC3, TTC39A, TTC39C, TTLL1, TTLL7, TTPAL, TUBD1, TWNK, TXNL4A, TXNL4B, TXNRD1, TYK2, U2AF1, UBA2, UBA52, UBAP2, UBE2D2, UBE2D3, UBE2E3, UBE21, UBE2J2, UBE3A, UBL7, UBXNI1, UBXN7, UGDH, UGGT1, UGP2, UMAD1, ACO007161.3, UNC45A, UQCC1, URGCP-MRPS24, URGCP, USMGS, USP16, USP21, USP28, USP3, USP33, USP35, USP54, USP9Y, USPL1, UTP15, VARS2, VASH2, VAV3, VDAC1, VDAC2, VDR, VEZT, VGF, VIL1, VILL, VIPR1, VPS29, VPS37C, VPS8, VPS9D1, VRK2, VWA1, VWASA, WARS, WASF1, WASHCS, WBPS, WDHD1, WDPCP, WDR37, WDR53, WDR6, WDR72, WDR74, WDR81, WDR86, WDYHV1, WFDC3, WHSC1, WIPF1, WSCD2, WWP2, XAGE1A, XAGEIB, XKR9, XPNPEP1, XRCC3, XRN2, XXYLT1, YIF1A, YIF1B, YIPF1, YIPFS, YPELS, YWHAB, YWHAZ, YYIAP1, ZBTB1, ZBTB14, ZBTB18, ZBTB20, ZBTB21, ZBTB25, ZBTB33, ZBTB34, ZBTB38, ZBTB43, ZBTB49, ZBTB7B, ZBTB7C, ZBTB8OS, ZC3H11A, ZBED6, ZC3H13, ZCCHC17, ZCCHC7, ZDHHC11, ZDHHC13, ZEB2, ZFANDS, ZFAND6, ZFP1, ZFP62, ZFX, ZFYVE16, ZFYVE19, ZFYVE20, ZFYVE27, ZHX2, AC016405.1, ZHX3, ZIK1, ZIM2, PEG3, ZKSCAN1, ZKSCAN3, ZKSCAN8, ZMAT3, ZMATS, ZMIZ2, ZMYM6, ZMYND11, ZNF10, AC026786.1, ZNF133, ZNF146, ZNF16, ZNF177, ZNF18, ZNF200, ZNF202, ZNF211, ZNF219, ZNF226, ZNF227, ZNF23, AC010547.4, ZNF23, AC010547.9, ZNF239, ZNF248, ZNF25, ZNF253, ZNF254, ZNF254, AC092279.1, ZNF263, ZNF274, ZNF275, ZNF28, ZNF468, ZNF283, ZNF287, ZNF3, ZNF320, ZNF322, ZNF324B, ZNF331, ZNF334, ZNF34, ZNF350, ZNF385A, ZNF395, FBX016, ZNF415, ZNF418, ZNF43, ZNF433-AS1, AC008770.4, ZNF438, ZNF444, ZNF445, ZNF467, ZNF480, ZNF493, ZNF493, CTD-2561J22.3, ZNF502, ZNF507, ZNF512, AC074091.1, ZNF512, RP11-158I13.2, ZNF512B, ZNF512B, SAMD10, ZNF521, ZNF532, ZNF544, AC020915.5, ZNF544, CTD-3138B18.4, ZNF559, ZNF177, ZNF562, ZNF567, ZNF569, ZNF570, ZNF571-AS1, ZNF540, ZNF577, ZNF580, ZNF581, ZNF580, ZNF581, CCDC106, ZNF600, ZNF611, ZNF613, ZNF615, ZNF619, ZNF620, ZNF639, ZNF652, ZNF665, ZNF667, ZNF668, ZNF671, ZNF682, ZNF687, ZNF691, ZNF696, ZNF701, ZNF706, ZNF707, ZNF714, ZNF717, ZNF718, ZNF720, ZNF721, ZNF730, ZNF763, ZNF780B, AC005614.5, ZNF782, ZNF786, ZNF79, ZNF791, ZNF81, ZNF83, ZNF837, ZNF839, ZNF84, ZNF845, ZNF846, ZNF865, ZNF91, ZNF92, ZNHIT3, ZSCAN21, ZSCAN25, ZSCAN30, and ZSCAN32.

In some embodiments, the gene encoding a target sequence comprises the HTT gene.

Exemplary genes that may be modulated by the compounds of Formula (I) described herein may also include, inter alia, AC005258.1, AC005943.1, AC007849.1, AC008770.2, AC010487.3, AC011477.4, AC012651.1, AC012531.3, AC034102.2, AC073896.4, AC104472.3, AL109811.3, AL133342.1, AL137782.1, AL157871.5, AF241726.2, AL355336.1, AL358113.1, AL360181.3, AL445423.2, AL691482.3, AP001267.5, RF01169, and RF02271.

The compounds described herein may further be used to modulate a sequence comprising a particular splice site sequence, e.g., an RNA sequence (e.g., a pre-mRNA sequence). In some embodiments, the splice site sequence comprises a 5' splice site sequence. In some embodiments, the splice site sequence comprises a 3' splice site sequence. Exemplary gene sequences and splice site sequences (e.g., 5' splice site sequences) include AAAgcaaguu (SEQ ID NO: 1), AAAguaaaaa (SEQ ID NO: 2), AAAguaaaau (SEQ ID NO: 3), AAAguaaagu (SEQ ID NO: 4), AAAguaaaua (SEQ ID NO: 5), AAAguaaaug (SEQ ID NO: 6), AAAguaaauu (SEQ ID NO: 7), AAAguaacac (SEQ ID NO: 8), AAAguaacca (SEQ ID NO: 9), AAAguaacuu (SEQ ID NO: 10), AAAguaagaa (SEQ ID NO: 11), AAAguaagac (SEQ ID NO: 12), AAAguaagag (SEQ ID NO: 13), AAAguaagau (SEQ ID NO: 14), AAAguaagca (SEQ ID NO: 15), AAAguaagcc (SEQ ID NO: 16), AAAguaagcu (SEQ ID NO: 17), AAAguaagga (SEQ ID NO: 18), AAAguaaggg (SEQ ID NO: 19), AAAguaaggu (SEQ ID NO: 20), AAAguaagua (SEQ ID NO: 21), AAAguaaguc (SEQ ID NO: 22), AAAguaagug (SEQ ID NO: 23), AAAguaaguu (SEQ ID NO: 24), AAAguaaucu (SEQ ID NO: 25), AAAguaauua (SEQ ID NO: 26), AAAguacaaa (SEQ ID NO: 27), AAAguaccgg (SEQ ID NO: 28), AAAguacuag (SEQ ID NO: 29), AAAguacugg (SEQ ID NO: 30), AAAguacuuc (SEQ ID NO: 31), AAAguacuug (SEQ ID NO: 32), AAAguagcuu (SEQ ID NO: 33), AAAguaggag (SEQ ID NO: 34), AAAguaggau (SEQ ID NO: 35), AAAguagggg (SEQ ID NO: 36), AAAguaggua (SEQ ID NO: 37), AAAguaguaa (SEQ ID NO: 38), AAAguauauu (SEQ ID NO: 39), AAAguauccu (SEQ ID NO: 40), AAAguaucuc (SEQ ID NO: 41), AAAguaugga (SEQ ID NO: 42), AAAguaugua (SEQ ID NO: 43), AAAguaugug (SEQ ID NO: 44), AAAguauguu (SEQ ID NO: 45), AAAguauugg (SEQ ID NO: 46), AAAguauuuu (SEQ ID NO: 47), AAAgucagau (SEQ ID NO: 48), AAAgucugag (SEQ ID NO: 49), AAAgugaaua (SEQ ID NO: 50), AAAgugagaa (SEQ ID NO: 51), AAAgugagac (SEQ ID NO: 52), AAAgugagag (SEQ ID NO: 53), AAAgugagau (SEQ ID NO: 54), AAAgugagca (SEQ ID NO: 55), AAAgugagcu (SEQ ID NO: 56), AAAgugaggg (SEQ ID NO: 57), AAAgugagua (SEQ ID NO: 58), AAAgugaguc (SEQ ID NO: 59), AAAgugagug (SEQ ID NO: 60), AAAgugaguu (SEQ ID NO: 61), AAAgugcguc (SEQ ID NO: 62), AAAgugcuga (SEQ ID NO: 63), AAAgugggu c (SEQ ID NO: 64), AAAguggguu (SEQ ID NO: 65), AAAgugguaa (SEQ ID NO: 66), AAAguguaug (SEQ ID NO: 67), AAAgugugug (SEQ ID NO: 68), AAAguguguu (SEQ ID NO: 69), AAAguuaagu (SEQ ID NO: 70), AAAguuacuu (SEQ ID NO: 71), AAAguuagug (SEQ ID NO: 72), AAAguuaugu (SEQ ID NO: 73), AAAguugagu (SEQ ID NO: 74), AAAguuugua (SEQ ID NO: 75), AACguaaaac (SEQ ID NO: 76), AACguaaagc (SEQ ID NO: 77), AACguaaagg (SEQ ID NO: 78), AACguaagca (SEQ ID NO: 79), AACguaaggg (SEQ ID NO: 80), AACguaaguc (SEQ ID NO: 81), AACguaagug (SEQ ID NO: 82), AACguaaugg (SEQ ID NO: 83), AACguaguga (SEQ ID NO: 84), AACguaugua (SEQ ID NO: 85), AACguauguu (SEQ ID NO: 86), AACgugagca (SEQ ID NO: 87), AACgugagga (SEQ ID NO: 88), AACgugauuu (SEQ ID NO: 89), AACgugggau (SEQ ID NO: 90), AACgugggua (SEQ ID NO: 91), AACguguguu (SEQ ID NO: 92), AACguuggua (SEQ ID NO: 93), AAGgcaaauu (SEQ ID NO: 94), AAGgcaagag (SEQ ID NO: 95), AAGgcaagau (SEQ ID NO: 96), AAGgcaagcc (SEQ ID NO: 97), AAGgcaagga (SEQ ID NO: 98), AAGgcaaggg (SEQ ID NO: 99), AAGgcaagug (SEQ ID NO: 100), AAGgcaaguu (SEQ ID NO: 101), AAGgcacugc (SEQ ID NO: 102), AAGgcagaaa (SEQ ID NO: 103), AAGgcaggau (SEQ ID NO: 104), AAGgcaggca (SEQ ID NO: 105), AAGgcaggga (SEQ ID NO: 106), AAGgcagggg (SEQ ID NO: 107), AAGgcaggua (SEQ ID NO: 108), AAGgcaggug (SEQ ID NO: 109), AAGgcaucuc (SEQ ID NO: 110), AAGgcaugcu (SEQ ID NO: 111), AAGgcaugga (SEQ ID NO: 112), AAGgcauguu (SEQ ID NO: 113), AAGgcauuau (SEQ ID NO: 114), AAGgcgagcu (SEQ ID NO: 115), AAGgcgaguc (SEQ ID NO: 116), AAGgcgaguu (SEQ ID NO: 117), AAGgcuagcc (SEQ ID NO: 118), AAGguaaaaa (SEQ ID NO: 119), AAGguaaaac (SEQ ID NO: 120), AAGguaaaag (SEQ ID NO: 121), AAGguaaaau (SEQ ID NO: 122), AAGguaaaca (SEQ ID NO: 123), AAGguaaacc (SEQ ID NO: 124), AAGguaaacu (SEQ ID NO: 125), AAGguaaaga (SEQ ID NO: 126), AAGguaaagc (SEQ ID NO: 127), AAGguaaagg (SEQ ID NO: 128), AAGguaaagu (SEQ ID NO: 129), AAGguaaaua (SEQ ID NO: 130), AAGguaaauc (SEQ ID NO: 131), AAGguaaaug (SEQ ID NO: 132), AAGguaaauu (SEQ ID NO: 133), AAGguaacaa (SEQ ID NO: 134), AAGguaacau (SEQ ID NO: 135), AAGguaaccc (SEQ ID NO: 136), AAGguaacua (SEQ ID NO: 137), AAGguaacuc (SEQ ID NO: 138), AAGguaacug (SEQ ID NO: 139), AAGguaacuu (SEQ ID NO: 140), AAGguaagaa (SEQ ID NO: 141), AAGguaagac (SEQ ID NO: 142), AAGguaagag (SEQ ID NO: 143), AAGguaagau (SEQ ID NO: 144), AAGguaagca (SEQ ID NO: 145), AAGguaagcc (SEQ ID NO: 146), AAGguaagcg (SEQ ID NO: 147), AAGguaagcu (SEQ ID NO: 148), AAGguaagga (SEQ ID NO: 149), AAGguaaggc (SEQ ID NO: 150), AAGguaaggg (SEQ ID NO: 151), AAGguaaggu (SEQ ID NO: 152), AAGguaagua (SEQ ID NO: 153), AAGguaaguc (SEQ ID NO: 154), AAGguaagug (SEQ ID NO: 155), AAGguaaguu (SEQ ID NO: 156), AAGguaauaa (SEQ ID NO: 157), AAGguaauac (SEQ ID NO: 158), AAGguaauag (SEQ ID NO: 159), AAGguaauau (SEQ ID NO: 160), AAGguaauca (SEQ ID NO: 161), AAGguaaucc (SEQ ID NO: 162), AAGguaaucu (SEQ ID NO: 163), AAGguaauga (SEQ ID NO: 164), AAGguaaugc (SEQ ID NO: 165), AAGguaaugg (SEQ ID NO: 166), AAGguaaugu (SEQ ID NO: 167), AAGguaauua (SEQ ID NO: 168), AAGguaauuc (SEQ ID NO: 169), AAGguaauug (SEQ ID NO: 170), AAGguaauuu (SEQ ID NO: 171), AAGguacaaa (SEQ ID NO: 172), AAGguacaag (SEQ ID NO: 173), AAGguacaau (SEQ ID NO: 174), AAGguacacc (SEQ ID NO: 175), AAGguacacu (SEQ ID NO: 176), AAGguacagg (SEQ ID NO: 177), AAGguacagu (SEQ ID NO: 178), AAGguacaua (SEQ ID NO: 179), AAGguacaug (SEQ ID NO: 180), AAGguacauu (SEQ ID NO: 181), AAGguaccaa (SEQ ID NO: 182), AAGguaccag (SEQ ID NO: 183), AAGguaccca (SEQ ID NO: 184), AAGguacccu (SEQ ID NO: 185), AAGguaccuc (SEQ ID NO: 186), AAGguaccug (SEQ ID NO: 187), AAGguaccuu (SEQ ID NO: 188), AAGguacgaa (SEQ ID NO: 189), AAGguacggg (SEQ ID NO: 190), AAGguacggu (SEQ ID NO: 191), AAGguacguc (SEQ ID NO: 192), AAGguacguu (SEQ ID NO: 193), AAGguacuaa (SEQ ID NO: 194), AAGguacuau (SEQ ID NO: 195), AAGguacucu (SEQ ID NO: 196), AAGguacuga (SEQ ID NO: 197), AAGguacugc (SEQ ID NO: 198), AAGguacugu (SEQ ID NO: 199), AAGguacuuc (SEQ ID NO: 200), AAGguacuug (SEQ ID NO: 201), AAGguacuuu (SEQ ID NO: 202), AAGguagaaa (SEQ ID NO: 203), AAGguagaac (SEQ ID NO: 204), AAGguagaca (SEQ ID NO: 205), AAGguagacc (SEQ ID NO: 206), AAGguagacu (SEQ ID NO: 207), AAGguagagu (SEQ ID NO: 208), AAGguagaua (SEQ ID NO: 209), AAGguagcaa (SEQ ID NO: 210), AAGguagcag (SEQ ID NO: 211), AAGguagcca (SEQ ID NO: 212), AAGguagccu (SEQ ID NO: 213), AAGguagcua (SEQ ID NO: 214), AAGguagcug (SEQ ID NO: 215), AAGguagcuu (SEQ ID NO: 216), AAGguaggaa (SEQ ID NO: 217), AAGguaggag (SEQ ID NO: 218), AAGguaggau (SEQ ID NO: 219), AAGguaggca (SEQ ID NO: 220), AAGguaggcc (SEQ ID NO: 221), AAGguaggcu (SEQ ID NO: 222), AAGguaggga (SEQ ID NO: 223), AAGguagggc (SEQ ID NO: 224), AAGguagggg (SEQ ID NO: 225), AAGguagggu (SEQ ID NO: 226), AAGguaggua (SEQ ID NO: 227), AAGguagguc (SEQ ID NO: 228), AAGguaggug (SEQ ID NO: 229), AAGguagguu (SEQ ID NO: 230), AAGguaguaa (SEQ ID NO: 231), AAGguaguag (SEQ ID NO: 232), AAGguagucu (SEQ ID NO: 233), AAGguagugc (SEQ ID NO: 234), AAGguagugg (SEQ ID NO: 235), AAGguaguuc (SEQ ID NO: 236), AAGguaguuu (SEQ ID NO: 237), AAGguauaaa (SEQ ID NO: 238), AAGguauaau (SEQ ID NO: 239), AAGguauaca (SEQ ID NO: 240), AAGguauacu (SEQ ID NO: 241), AAGguauaua (SEQ ID NO: 242), AAGguauauc (SEQ ID NO: 243), AAGguauaug (SEQ ID NO: 244), AAGguauauu (SEQ ID NO: 245), AAGguaucac (SEQ ID NO: 246), AAGguaucag (SEQ ID NO: 247), AAGguauccc (SEQ ID NO: 248), AAGguauccu (SEQ ID NO: 249), AAGguaucuc (SEQ ID NO: 250), AAGguaucug (SEQ ID NO: 251), AAGguaucuu (SEQ ID NO: 252), AAGguaugaa (SEQ ID NO: 253), AAGguaugac (SEQ ID NO: 254), AAGguaugag (SEQ ID NO: 255), AAGguaugau (SEQ ID NO: 256), AAGguaugca (SEQ ID NO: 257), AAGguaugcc (SEQ ID NO: 258), AAGguaugcu (SEQ ID NO: 259), AAGguaugga (SEQ ID NO: 260), AAGguauggc (SEQ ID NO: 261), AAGguauggg (SEQ ID NO: 262), AAGguaugua (SEQ ID NO: 263), AAGguauguc (SEQ ID NO: 264), AAGguaugug (SEQ ID NO: 265), AAGguauguu (SEQ ID NO: 266), AAGguauuaa (SEQ ID NO: 267), AAGguauuac (SEQ ID NO: 268), AAGguauuag (SEQ ID NO: 269), AAGguauuau (SEQ ID NO: 270), AAGguauucc (SEQ ID NO: 271), AAGguauuga (SEQ ID NO: 272), AAGguauugu (SEQ ID NO: 273), AAGguauuua (SEQ ID NO: 274), AAGguauuuc (SEQ ID NO: 275), AAGguauuug (SEQ ID NO: 276), AAGguauuuu (SEQ ID NO: 277), AAGgucaaau (SEQ ID NO: 278), AAGgucaaga (SEQ ID NO: 279), AAGgucaagu (SEQ ID NO: 280), AAGgucacag (SEQ ID NO: 281), AAGgucagaa (SEQ ID NO: 282), AAGgucagac (SEQ ID NO: 283), AAGgucagag (SEQ ID NO: 284), AAGgucagca (SEQ ID NO: 285), AAGgucagcc (SEQ ID NO: 286), AAGgucagcg (SEQ ID NO: 287), AAGgucagcu (SEQ ID NO: 288), AAGgucagga (SEQ ID NO: 289), AAGgucaggc (SEQ ID NO: 290), AAGgucaggg (SEQ ID NO: 291), AAGgucaggu (SEQ ID NO: 292), AAGgucagua (SEQ ID NO: 293), AAGgucaguc (SEQ ID NO: 294), AAGgucagug (SEQ ID NO: 295), AAGgucaguu (SEQ ID NO: 296), AAGgucauag (SEQ ID NO: 297), AAGgucaucu (SEQ ID NO: 298), AAGguccaca (SEQ ID NO: 299), AAGguccaga (SEQ ID NO: 300), AAGguccaua (SEQ ID NO: 301), AAGgucccag (SEQ ID NO: 302), AAGgucccuc (SEQ ID NO: 303), AAGguccuuc (SEQ ID NO: 304), AAGgucgagg (SEQ ID NO: 305), AAGgucuaau (SEQ ID NO: 306), AAGgucuacc (SEQ ID NO: 307), AAGgucuaua (SEQ ID NO: 308), AAGgucuccu (SEQ ID NO: 309), AAGgucucug (SEQ ID NO: 310), AAGgucucuu (SEQ ID NO: 311), AAGgucugaa (SEQ ID NO: 312), AAGgucugag (SEQ ID NO: 313), AAGgucugga (SEQ ID NO: 314), AAGgucuggg (SEQ ID NO: 315), AAGgucugua (SEQ ID NO: 316), AAGgucuguu (SEQ ID NO: 317), AAGgucuucu (SEQ ID NO: 318), AAGgucuuuu (SEQ ID NO: 319), AAGgugaaac (SEQ ID NO: 320), AAGgugaaag (SEQ ID NO: 321), AAGgugaaau (SEQ ID NO: 322), AAGgugaacu (SEQ ID NO: 323), AAGgugaagc (SEQ ID NO: 324), AAGgugaagg (SEQ ID NO: 325), AAGgugaagu (SEQ ID NO: 326), AAGgugaaua (SEQ ID NO: 327), AAGgugaaug (SEQ ID NO: 328), AAGgugaauu (SEQ ID NO: 329), AAGgugacaa (SEQ ID NO: 330), AAGgugacag (SEQ ID NO: 331), AAGgugacau (SEQ ID NO: 332), AAGgugacug (SEQ ID NO: 333), AAGgugacuu (SEQ ID NO: 334), AAGgugagaa (SEQ ID NO: 335), AAGgugagac (SEQ ID NO: 336), AAGgugagag (SEQ ID NO: 337), AAGgugagau (SEQ ID NO: 338), AAGgugagca (SEQ ID NO: 339), AAGgugagcc (SEQ ID NO: 340), AAGgugagcg (SEQ ID NO: 341), AAGgugagcu (SEQ ID NO: 342), AAGgugagga (SEQ ID NO: 343), AAGgugaggc (SEQ ID NO: 344), AAGgugaggg (SEQ ID NO: 345), AAGgugaggu (SEQ ID NO: 346), AAGgugagua (SEQ ID NO: 347), AAGgugaguc (SEQ ID NO: 348), AAGgugagug (SEQ ID NO: 349), AAGgugaguu (SEQ ID NO: 350), AAGgugauaa (SEQ ID NO: 351), AAGgugauca (SEQ ID NO: 352), AAGgugaucc (SEQ ID NO: 353), AAGgugauga (SEQ ID NO: 354), AAGgugaugc (SEQ ID NO: 355), AAGgugaugu (SEQ ID NO: 356), AAGgugauua (SEQ ID NO: 357), AAGgugauug (SEQ ID NO: 358), AAGgugauuu (SEQ ID NO: 359), AAGgugcaca (SEQ ID NO: 360), AAGgugcauc (SEQ ID NO: 361), AAGgugcccu (SEQ ID NO: 362), AAGgugccug (SEQ ID NO: 363), AAGgugcgug (SEQ ID NO: 364), AAGgugcguu (SEQ ID NO: 365), AAGgugcucc (SEQ ID NO: 366), AAGgugcuga (SEQ ID NO: 367), AAGgugcugc (SEQ ID NO: 368), AAGgugcugg (SEQ ID NO: 369), AAGgugcuua (SEQ ID NO: 370), AAGgugcuuu (SEQ ID NO: 371), AAGguggaua (SEQ ID NO: 372), AAGguggcua (SEQ ID NO: 373), AAGguggcug (SEQ ID NO: 374), AAGguggcuu (SEQ ID NO: 375), AAGgugggaa (SEQ ID NO: 376), AAGgugggag (SEQ ID NO: 377), AAGgugggau (SEQ ID NO: 378), AAGgugggca (SEQ ID NO: 379), AAGgugggcc (SEQ ID NO: 380), AAGgugggcg (SEQ ID NO: 381), AAGgugggga (SEQ ID NO: 382), AAGguggggu (SEQ ID NO: 383), AAGgugggua (SEQ ID NO: 384), AAGgugggug (SEQ ID NO: 385), AAGguggguu (SEQ ID NO: 386), AAGgugguaa (SEQ ID NO: 387), AAGgugguac (SEQ ID NO: 388), AAGgugguau (SEQ ID NO: 389), AAGguggugg (SEQ ID NO: 390), AAGgugguua (SEQ ID NO: 391), AAGgugguuc (SEQ ID NO: 392), AAGgugguuu (SEQ ID NO: 393), AAGguguaag (SEQ ID NO: 394), AAGgugucaa (SEQ ID NO: 395), AAGgugucag (SEQ ID NO: 396), AAGgugucug (SEQ ID NO: 397), AAGgugugaa (SEQ ID NO: 398), AAGgugugag (SEQ ID NO: 399), AAGgugugca (SEQ ID NO: 400), AAGgugugga (SEQ ID NO: 401), AAGguguggu (SEQ ID NO: 402), AAGgugugua (SEQ ID NO: 403), AAGguguguc (SEQ ID NO: 404), AAGgugugug (SEQ ID NO: 405), AAGguguguu (SEQ ID NO: 406), AAGguguucu (SEQ ID NO: 407), AAGguguugc (SEQ ID NO: 408), AAGguguugg (SEQ ID NO: 409), AAGguguuug (SEQ ID NO: 410), AAGguuaaaa (SEQ ID NO: 411), AAGguuaaca (SEQ ID NO: 412), AAGguuaagc (SEQ ID NO: 413), AAGguuaauu (SEQ ID NO: 414), AAGguuacau (SEQ ID NO: 415), AAGguuagaa (SEQ ID NO: 416), AAGguuagau (SEQ ID NO: 417), AAGguuagca (SEQ ID NO: 418), AAGguuagcc (SEQ ID NO: 419), AAGguuagga (SEQ ID NO: 420), AAGguuaggc (SEQ ID NO: 421), AAGguuagua (SEQ ID NO: 422), AAGguuaguc (SEQ ID NO: 423), AAGguuagug (SEQ ID NO: 424), AAGguuaguu (SEQ ID NO: 425), AAGguuauag (SEQ ID NO: 426), AAGguuauga (SEQ ID NO: 427), AAGguucaaa (SEQ ID NO: 428), AAGguucaag (SEQ ID NO: 429), AAGguuccuu (SEQ ID NO: 430), AAGguucggc (SEQ ID NO: 431), AAGguucguu (SEQ ID NO: 432), AAGguucuaa (SEQ ID NO: 433), AAGguucuga (SEQ ID NO: 434), AAGguucuua (SEQ ID NO: 435), AAGguugaau (SEQ ID NO: 436), AAGguugacu (SEQ ID NO: 437), AAGguugagg (SEQ ID NO: 438), AAGguugagu (SEQ ID NO: 439), AAGguugaua (SEQ ID NO: 440), AAGguugcac (SEQ ID NO: 441), AAGguugcug (SEQ ID NO: 442), AAGguuggaa (SEQ ID NO: 443), AAGguuggca (SEQ ID NO: 444), AAGguuggga (SEQ ID NO: 445), AAGguugggg (SEQ ID NO: 446), AAGguuggua (SEQ ID NO: 447), AAGguugguc (SEQ ID NO: 448), AAGguuggug (SEQ ID NO: 449), AAGguugguu (SEQ ID NO: 450), AAGguuguaa (SEQ ID NO: 451), AAGguugucc (SEQ ID NO: 452), AAGguugugc (SEQ ID NO: 453), AAGguuguua (SEQ ID NO: 454), AAGguuuacc (SEQ ID NO: 455), AAGguuuaua (SEQ ID NO: 456), AAGguuuauu (SEQ ID NO: 457), AAGguuuccu (SEQ ID NO: 458), AAGguuucgu (SEQ ID NO: 459), AAGguuugag (SEQ ID NO: 460), AAGguuugca (SEQ ID NO: 461), AAGguuugcc (SEQ ID NO: 462), AAGguuugcu (SEQ ID NO: 463), AAGguuugga (SEQ ID NO: 464), AAGguuuggu (SEQ ID NO: 465), AAGguuugua (SEQ ID NO: 466), AAGguuuguc (SEQ ID NO: 467), AAGguuugug (SEQ ID NO: 468), AAGguuuuaa (SEQ ID NO: 469), AAGguuuuca (SEQ ID NO: 470), AAGguuuucg (SEQ ID NO: 471), AAGguuuugc (SEQ ID NO: 472), AAGguuuugu (SEQ ID NO: 473), AAGguuuuuu (SEQ ID NO: 474), AAUgcaagua (SEQ ID NO: 475), AAUgcaaguc (SEQ ID NO: 476), AAUguaaaca (SEQ ID NO: 477), AAUguaaaua (SEQ ID NO: 478), AAUguaaauc (SEQ ID NO: 479), AAUguaaaug (SEQ ID NO: 480), AAUguaaauu (SEQ ID NO: 481), AAUguaacua (SEQ ID NO: 482), AAUguaagaa (SEQ ID NO: 483), AAUguaagag (SEQ ID NO: 484), AAUguaagau (SEQ ID NO: 485), AAUguaagcc (SEQ ID NO: 486), AAUguaagcu (SEQ ID NO: 487), AAUguaagga (SEQ ID NO: 488), AAUguaagua (SEQ ID NO: 489), AAUguaaguc (SEQ ID NO: 490), AAUguaagug (SEQ ID NO: 491), AAUguaaguu (SEQ ID NO: 492), AAUguaauca (SEQ ID NO: 493), AAUguaauga (SEQ ID NO: 494), AAUguaaugu (SEQ ID NO: 495), AAUguacauc (SEQ ID NO: 496), AAUguacaug (SEQ ID NO: 497), AAUguacgau (SEQ ID NO: 498), AAUguacgua (SEQ ID NO: 499), AAUguacguc (SEQ ID NO: 500), AAUguacgug (SEQ ID NO: 501), AAUguacucu (SEQ ID NO: 502), AAUguaggca (SEQ ID NO: 503), AAUguagguu (SEQ ID NO: 504), AAUguaucua (SEQ ID NO: 505), AAUguaugaa (SEQ ID NO: 506), AAUguaugua (SEQ ID NO: 507), AAUguaugug (SEQ ID NO: 508), AAUguauguu (SEQ ID NO: 509), AAUgucagag (SEQ ID NO: 510), AAUgucagau (SEQ ID NO: 511), AAUgucagcu (SEQ ID NO: 512), AAUgucagua (SEQ ID NO: 513), AAUgucaguc (SEQ ID NO: 514), AAUgucagug (SEQ ID NO: 515), AAUgucaguu (SEQ ID NO: 516), AAUgucggua (SEQ ID NO: 517), AAUgucuguu (SEQ ID NO: 518), AAUgugagaa (SEQ ID NO: 519), AAUgugagca (SEQ ID NO: 520), AAUgugagcc (SEQ ID NO: 521), AAUgugagga (SEQ ID NO: 522), AAUgugagua (SEQ ID NO: 523), AAUgugaguc (SEQ ID NO: 524), AAUgugagug (SEQ ID NO: 525), AAUgugaguu (SEQ ID NO: 526), AAUgugauau (SEQ ID NO: 527), AAUgugcaua (SEQ ID NO: 528), AAUgugcgua (SEQ ID NO: 529), AAUgugcguc (SEQ ID NO: 530), AAUgugggac (SEQ ID NO: 531), AAUgugggguc (SEQ ID NO: 532), AAUgugggug (SEQ ID NO: 533), AAUgugguuu (SEQ ID NO: 534), AAUgugugua (SEQ ID NO: 535), AAUguuaagu (SEQ ID NO: 536), AAUguuagaa (SEQ ID NO: 537), AAUguuagau (SEQ ID NO: 538), AAUguuagua (SEQ ID NO: 539), AAUguuggug (SEQ ID NO: 540), ACAgcaagua (SEQ ID NO: 541), ACAguaaaua (SEQ ID NO: 542), ACAguaaaug (SEQ ID NO: 543), ACAguaagaa (SEQ ID NO: 544), ACAguaagca (SEQ ID NO: 545), ACAguaagua (SEQ ID NO: 546), ACAguaaguc (SEQ ID NO: 547), ACAguaagug (SEQ ID NO: 548), ACAguaaguu (SEQ ID NO: 549), ACAguacgua (SEQ ID NO: 550), ACAguaggug (SEQ ID NO: 551), ACAguauaac (SEQ ID NO: 552), ACAguaugua (SEQ ID NO: 553), ACAgucaguu (SEQ ID NO: 554), ACAgugagaa (SEQ ID NO: 555), ACAgugagcc (SEQ ID NO: 556), ACAgugagcu (SEQ ID NO: 557), ACAgugagga (SEQ ID NO: 558), ACAgugaggu (SEQ ID NO: 559), ACAgugagua (SEQ ID NO: 560), ACAgugaguc (SEQ ID NO: 561), ACAgugagug (SEQ ID NO: 562), ACAgugaguu (SEQ ID NO: 563), ACAgugggua (SEQ ID NO: 564), ACAgugguu (SEQ ID NO: 565), ACAguguaaa (SEQ ID NO: 566), ACAguuaagc (SEQ ID NO: 567), ACAguuaagu (SEQ ID NO: 568), ACAguuaugu (SEQ ID NO: 569), ACAguugagu (SEQ ID NO: 570), ACAguuguga (SEQ ID NO: 571), ACCguaagua (SEQ ID NO: 572), ACCgugagaa (SEQ ID NO: 573), ACCgugagca (SEQ ID NO: 574), ACCgugaguu (SEQ ID NO: 575), ACCgugggug (SEQ ID NO: 576), ACGguaaaac (SEQ ID NO: 577), ACGguaacua (SEQ ID NO: 578), ACGguaagua (SEQ ID NO: 579), ACGguaagug (SEQ ID NO: 580), ACGguaaguu (SEQ ID NO: 581), ACGguaauua (SEQ ID NO: 582), ACGguaauuu (SEQ ID NO: 583), ACGguacaau (SEQ ID NO: 584), ACGguacagu (SEQ ID NO: 585), ACGguaccag (SEQ ID NO: 586), ACGguacggu (SEQ ID NO: 587), ACGguacgua (SEQ ID NO: 588), ACGguaggaa (SEQ ID NO: 589), ACGguaggag (SEQ ID NO: 590), ACGguaggug (SEQ ID NO: 591), ACGguaguaa (SEQ ID NO: 592), ACGguauaau (SEQ ID NO: 593), ACGguaugac (SEQ ID NO: 594), ACGguaugcg (SEQ ID NO: 595), ACGguaugua (SEQ ID NO: 596), ACGguauguc (SEQ ID NO: 597), ACGgugaaac (SEQ ID NO: 598), ACGgugaagu (SEQ ID NO: 599), ACGgugaauc (SEQ ID NO: 600), ACGgugacag (SEQ ID NO: 601), ACGgugacca (SEQ ID NO: 602), ACGgugagaa (SEQ ID NO: 603), ACGgugagau (SEQ ID NO: 604), ACGgugagcc (SEQ ID NO: 605), ACGgugagua (SEQ ID NO: 606), ACGgugagug (SEQ ID NO: 607), ACGgugaguu (SEQ ID NO: 608), ACGgugcgug (SEQ ID NO: 609), ACGguggcac (SEQ ID NO: 610), ACGguggggc (SEQ ID NO: 611), ACGgugggug (SEQ ID NO: 612), ACGguguagu (SEQ ID NO: 613), ACGgugucac (SEQ ID NO: 614), ACGgugugua (SEQ ID NO: 615), ACGguguguu (SEQ ID NO: 616), ACGguuagug (SEQ ID NO: 617), ACGguuaguu (SEQ ID NO: 618), ACGguucaau (SEQ ID NO: 619), ACUguaaaua (SEQ ID NO: 620), ACUguaagaa (SEQ ID NO: 621), ACUguaagac (SEQ ID NO: 622), ACUguaagca (SEQ ID NO: 623), ACUguaagcu (SEQ ID NO: 624), ACUguaagua (SEQ ID NO: 625), ACUguaaguc (SEQ ID NO: 626), ACUguaaguu (SEQ ID NO: 627), ACUguacguu (SEQ ID NO: 628), ACUguacugc (SEQ ID NO: 629), ACUguaggcu (SEQ ID NO: 630), ACUguaggua (SEQ ID NO: 631), ACUguauauu (SEQ ID NO: 632), ACUguaugaa (SEQ ID NO: 633), ACUguaugcu (SEQ ID NO: 634), ACUguaugug (SEQ ID NO: 635), ACUguauucc (SEQ ID NO: 636), ACUgucagcu (SEQ ID NO: 637), ACUgucagug (SEQ ID NO: 638), ACUgugaacg (SEQ ID NO: 639), ACUgugagca (SEQ ID NO: 640), ACUgugagcg (SEQ ID NO: 641), ACUgugagcu (SEQ ID NO: 642), ACUgugagua (SEQ ID NO: 643), ACUgugaguc (SEQ ID NO: 644), ACUgugagug (SEQ ID NO: 645), ACUgugaguu (SEQ ID NO: 646), ACUgugggua (SEQ ID NO: 647), ACUgugugug (SEQ ID NO: 648), ACUguuaagu (SEQ ID NO: 649), AGAgcaagua (SEQ ID NO: 650), AGAguaaaac (SEQ ID NO: 651), AGAguaaacg (SEQ ID NO: 652), AGAguaaaga (SEQ ID NO: 653), AGAguaaagu (SEQ ID NO: 654), AGAguaaauc (SEQ ID NO: 655), AGAguaaaug (SEQ ID NO: 656), AGAguaacau (SEQ ID NO: 657), AGAguaacua (SEQ ID NO: 658), AGAguaagaa (SEQ ID NO: 659), AGAguaagac (SEQ ID NO: 660), AGAguaagag (SEQ ID NO: 661), AGAguaagau (SEQ ID NO: 662), AGAguaagca (SEQ ID NO: 663), AGAguaagcu (SEQ ID NO: 664), AGAguaagga (SEQ ID NO: 665), AGAguaaggc (SEQ ID NO: 666), AGAguaaggg (SEQ ID NO: 667), AGAguaaggu (SEQ ID NO: 668), AGAguaaguc (SEQ ID NO: 669), AGAguaagug (SEQ ID NO: 670), AGAguaaguu (SEQ ID NO: 671), AGAguaauaa (SEQ ID NO: 672), AGAguaaugu (SEQ ID NO: 673), AGAguaauuc (SEQ ID NO: 674), AGAguaauuu (SEQ ID NO: 675), AGAguacacc (SEQ ID NO: 676), AGAguaccug (SEQ ID NO: 677), AGAguacgug (SEQ ID NO: 678), AGAguacucu (SEQ ID NO: 679), AGAguacuga (SEQ ID NO: 680), AGAguacuuu (SEQ ID NO: 681), AGAguagcug (SEQ ID NO: 682), AGAguaggaa (SEQ ID NO: 683), AGAguaggga (SEQ ID NO: 684), AGAguagggu (SEQ ID NO: 685), AGAguagguc (SEQ ID NO: 686), AGAguaggug (SEQ ID NO: 687), AGAguagguu (SEQ ID NO: 688), AGAguauaua (SEQ ID NO: 689), AGAguauauu (SEQ ID NO: 690), AGAguaugaa (SEQ ID NO: 691), AGAguaugac (SEQ ID NO: 692), AGAguaugau (SEQ ID NO: 693), AGAguauguc (SEQ ID NO: 694), AGAguaugug (SEQ ID NO: 695), AGAguauguu (SEQ ID NO: 696), AGAguauuaa (SEQ ID NO: 697), AGAguauuau (SEQ ID NO: 698), AGAgucagug (SEQ ID NO: 699), AGAgugagac (SEQ ID NO: 700), AGAgugagag (SEQ ID NO: 701), AGAgugagau (SEQ ID NO: 702), AGAgugagca (SEQ ID NO: 703), AGAgugagua (SEQ ID NO: 704), AGAgugaguc (SEQ ID NO: 705), AGAgugagug (SEQ ID NO: 706), AGAgugaguu (SEQ ID NO: 707), AGAgugcguc (SEQ ID NO: 708), AGAgugggga (SEQ ID NO: 709), AGAguggggug (SEQ ID NO: 710), AGAgugugug (SEQ ID NO: 711), AGAguguuuc (SEQ ID NO: 712), AGAguuagua (SEQ ID NO: 713), AGAguugaga (SEQ ID NO: 714), AGAguugagu (SEQ ID NO: 715), AGAguugguu (SEQ ID NO: 716), AGAguuugau (SEQ ID NO: 717), AGCguaagcu (SEQ ID NO: 718), AGCguaagug (SEQ ID NO: 719), AGCgugagcc (SEQ ID NO: 720), AGCgugagug (SEQ ID NO: 721), AGCguuguuc (SEQ ID NO: 722), AGGgcagagu (SEQ ID NO: 723), AGGgcagccu (SEQ ID NO: 724), AGGgcuagua (SEQ ID NO: 725), AGGguaaaga (SEQ ID NO: 726), AGGguaaaua (SEQ ID NO: 727), AGGguaaauc (SEQ ID NO: 728), AGGguaaauu (SEQ ID NO: 729), AGGguaacca (SEQ ID NO: 730), AGGguaacug (SEQ ID NO: 731), AGGguaacuu (SEQ ID NO: 732), AGGguaagaa (SEQ ID NO: 733), AGGguaagag (SEQ ID NO: 734), AGGguaagau (SEQ ID NO: 735), AGGguaagca (SEQ ID NO: 736), AGGguaagga (SEQ ID NO: 737), AGGguaaggc (SEQ ID NO: 738), AGGguaaggg (SEQ ID NO: 739), AGGguaagua (SEQ ID NO: 740), AGGguaaguc (SEQ ID NO: 741), AGGguaagug (SEQ ID NO: 742), AGGguaaguu (SEQ ID NO: 743), AGGguaauac (SEQ ID NO: 744), AGGguaauga (SEQ ID NO: 745), AGGguaauua (SEQ ID NO: 746), AGGguaauuu (SEQ ID NO: 747), AGGguacacc (SEQ ID NO: 748), AGGguacagu (SEQ ID NO: 749), AGGguacggu (SEQ ID NO: 750), AGGguaggac (SEQ ID NO: 751), AGGguaggag (SEQ ID NO: 752), AGGguaggca (SEQ ID NO: 753), AGGguaggcc (SEQ ID NO: 754), AGGguaggga (SEQ ID NO: 755), AGGguagggu (SEQ ID NO: 756), AGGguagguc (SEQ ID NO: 757), AGGguaggug (SEQ ID NO: 758), AGGguagguu (SEQ ID NO: 759), AGGguauaua (SEQ ID NO: 760), AGGguaugac (SEQ ID NO: 761), AGGguaugag (SEQ ID NO: 762), AGGguaugau (SEQ ID NO: 763), AGGguaugca (SEQ ID NO: 764), AGGguaugcu (SEQ ID NO: 765), AGGguauggg (SEQ ID NO: 766), AGGguauggu (SEQ ID NO: 767), AGGguaugua (SEQ ID NO: 768), AGGguauguc (SEQ ID NO: 769), AGGguaugug (SEQ ID NO: 770), AGGguauuac (SEQ ID NO: 771), AGGguauucu (SEQ ID NO: 772), AGGguauuuc (SEQ ID NO: 773), AGGgucagag (SEQ ID NO: 774), AGGgucagca (SEQ ID NO: 775), AGGgucagga (SEQ ID NO: 776), AGGgucaggg (SEQ ID NO: 777), AGGgucagug (SEQ ID NO: 778), AGGgucaguu (SEQ ID NO: 779), AGGguccccu (SEQ ID NO: 780), AGGgucggga (SEQ ID NO: 781), AGGgucugca (SEQ ID NO: 782), AGGgucuguu (SEQ ID NO: 783), AGGgugaaga (SEQ ID NO: 784), AGGgugacua (SEQ ID NO: 785), AGGgugagaa (SEQ ID NO: 786), AGGgugagac (SEQ ID NO: 787), AGGgugagag (SEQ ID NO: 788), AGGgugagca (SEQ ID NO: 789), AGGgugagcc (SEQ ID NO: 790), AGGgugagcu (SEQ ID NO: 791), AGGgugagga (SEQ ID NO: 792), AGGgugaggg (SEQ ID NO: 793), AGGgugaggu (SEQ ID NO: 794), AGGgugagua (SEQ ID NO: 795), AGGgugaguc (SEQ ID NO: 796), AGGgugagug (SEQ ID NO: 797), AGGgugaguu (SEQ ID NO: 798), AGGgugggga (SEQ ID NO: 799), AGGgugggggu (SEQ ID NO: 800), AGGgugggua (SEQ ID NO: 801), AGGgugggug (SEQ ID NO: 802), AGGgugugua (SEQ ID NO: 803), AGGgugugug (SEQ ID NO: 804), AGGguuaaug (SEQ ID NO: 805), AGGguuagaa (SEQ ID NO: 806), AGGguuaguu (SEQ ID NO: 807), AGGguuggug (SEQ ID NO: 808), AGGguuugug (SEQ ID NO: 809), AGGguuuguu (SEQ ID NO: 810), AGUguaaaag (SEQ ID NO: 811), AGUguaaaua (SEQ ID NO: 812), AGUguaaauu (SEQ ID NO: 813), AGUguaagaa (SEQ ID NO: 814), AGUguaagag (SEQ ID NO: 815), AGUguaagau (SEQ ID NO: 816), AGUguaagca (SEQ ID NO: 817), AGUguaagcc (SEQ ID NO: 818), AGUguaagua (SEQ ID NO: 819), AGUguaagug (SEQ ID NO: 820), AGUguaaguu (SEQ ID NO: 821), AGUguaauug (SEQ ID NO: 822), AGUguaggac (SEQ ID NO: 823), AGUguagguc (SEQ ID NO: 824), AGUguaugag (SEQ ID NO: 825), AGUguaugua (SEQ ID NO: 826), AGUguauguu (SEQ ID NO: 827), AGUguauugu (SEQ ID NO: 828), AGUguauuua (SEQ ID NO: 829), AGUgucaguc (SEQ ID NO: 830), AGUgugagag (SEQ ID NO: 831), AGUgugagca (SEQ ID NO: 832), AGUgugagcc (SEQ ID NO: 833), AGUgugagcu (SEQ ID NO: 834), AGUgugagua (SEQ ID NO: 835), AGUgugaguc (SEQ ID NO: 836), AGUgugagug (SEQ ID NO: 837), AGUgugaguu (SEQ ID NO: 838), AGUgugggua (SEQ ID NO: 839), AGUgugggug (SEQ ID NO: 840), AGUgugugua (SEQ ID NO: 841), AGUguuccua (SEQ ID NO: 842), AGUguugggg (SEQ ID NO: 843), AGUguuucag (SEQ ID NO: 844), AUAguaaaua (SEQ ID NO: 845), AUAguaagac (SEQ ID NO: 846), AUAguaagau (SEQ ID NO: 847), AUAguaagca (SEQ ID NO: 848), AUAguaagua (SEQ ID NO: 849), AUAguaagug (SEQ ID NO: 850), AUAguaaguu (SEQ ID NO: 851), AUAguaggua (SEQ ID NO: 852), AUAguauguu (SEQ ID NO: 853), AUAgucucac (SEQ ID NO: 854), AUAgugagac (SEQ ID NO: 855), AUAgugagag (SEQ ID NO: 856), AUAgugagau (SEQ ID NO: 857), AUAgugagcc (SEQ ID NO: 858), AUAgugaggc (SEQ ID NO: 859), AUAgugagua (SEQ ID NO: 860), AUAgugaguc (SEQ ID NO: 861), AUAgugagug (SEQ ID NO: 862), AUAgugcguc (SEQ ID NO: 863), AUAgugugua (SEQ ID NO: 864), AUAguucagu (SEQ ID NO: 865), AUCguaagcc (SEQ ID NO: 866), AUCguaaguu (SEQ ID NO: 867), AUCguauucc (SEQ ID NO: 868), AUCgugagua (SEQ ID NO: 869), AUGgcaagcg (SEQ ID NO: 870), AUGgcaagga (SEQ ID NO: 871), AUGgcaaguu (SEQ ID NO: 872), AUGgcaggua (SEQ ID NO: 873), AUGgcaugug (SEQ ID NO: 874), AUGgcgccau (SEQ ID NO: 875), AUGgcuugug (SEQ ID NO: 876), AUGguaaaac (SEQ ID NO: 877), AUGguaaaau (SEQ ID NO: 878), AUGguaaacc (SEQ ID NO: 879), AUGguaaaga (SEQ ID NO: 880), AUGguaaaua (SEQ ID NO: 881), AUGguaaaug (SEQ ID NO: 882), AUGguaaauu (SEQ ID NO: 883), AUGguaacag (SEQ ID NO: 884), AUGguaacau (SEQ ID NO: 885), AUGguaacua (SEQ ID NO: 886), AUGguaacuc (SEQ ID NO: 887), AUGguaacuu (SEQ ID NO: 888), AUGguaagaa (SEQ ID NO: 889), AUGguaagac (SEQ ID NO: 890), AUGguaagag (SEQ ID NO: 891), AUGguaagau (SEQ ID NO: 892), AUGguaagca (SEQ ID NO: 893), AUGguaagcc (SEQ ID NO: 894), AUGguaagcu (SEQ ID NO: 895), AUGguaagga (SEQ ID NO: 896), AUGguaaggg (SEQ ID NO: 897), AUGguaagua (SEQ ID NO: 898), AUGguaaguc (SEQ ID NO: 899), AUGguaagug (SEQ ID NO: 900), AUGguaaguu (SEQ ID NO: 901), AUGguaauaa (SEQ ID NO: 902), AUGguaauau (SEQ ID NO: 903), AUGguaauga (SEQ ID NO: 904), AUGguaaugg (SEQ ID NO: 905), AUGguaauug (SEQ ID NO: 906), AUGguaauuu (SEQ ID NO: 907), AUGguacagc (SEQ ID NO: 908), AUGguacauc (SEQ ID NO: 909), AUGguaccag (SEQ ID NO: 910), AUGguaccug (SEQ ID NO: 911), AUGguacgag (SEQ ID NO: 912), AUGguacggu (SEQ ID NO: 913), AUGguagauc (SEQ ID NO: 914), AUGguagcag (SEQ ID NO: 915), AUGguagcug (SEQ ID NO: 916), AUGguaggaa (SEQ ID NO: 917), AUGguaggau (SEQ ID NO: 918), AUGguaggca (SEQ ID NO: 919), AUGguaggcu (SEQ ID NO: 920), AUGguagggg (SEQ ID NO: 921), AUGguagggu (SEQ ID NO: 922), AUGguaggua (SEQ ID NO: 923), AUGguaggug (SEQ ID NO: 924), AUGguaguuu (SEQ ID NO: 925), AUGguauagu (SEQ ID NO: 926), AUGguauaua (SEQ ID NO: 927), AUGguaucag (SEQ ID NO: 928), AUGguaucuu (SEQ ID NO: 929), AUGguaugau (SEQ ID NO: 930), AUGguaugca (SEQ ID NO: 931), AUGguaugcc (SEQ ID NO: 932), AUGguaugcg (SEQ ID NO: 933), AUGguaugcu (SEQ ID NO: 934), AUGguaugga (SEQ ID NO: 935), AUGguauggc (SEQ ID NO: 936), AUGguaugug (SEQ ID NO: 937), AUGguauguu (SEQ ID NO: 938), AUGguauuau (SEQ ID NO: 939), AUGguauuga (SEQ ID NO: 940), AUGguauuug (SEQ ID NO: 941), AUGgucaggg (SEQ ID NO: 942), AUGgucaguc (SEQ ID NO: 943), AUGgucagug (SEQ ID NO: 944), AUGgucauuu (SEQ ID NO: 945), AUGgugaaaa (SEQ ID NO: 946), AUGgugaaac (SEQ ID NO: 947), AUGgugaaau (SEQ ID NO: 948), AUGgugaacu (SEQ ID NO: 949), AUGgugaaga (SEQ ID NO: 950), AUGgugacgu (SEQ ID NO: 951), AUGgugagaa (SEQ ID NO: 952), AUGgugagac (SEQ ID NO: 953), AUGgugagag (SEQ ID NO: 954), AUGgugagca (SEQ ID NO: 955), AUGgugagcc (SEQ ID NO: 956), AUGgugagcg (SEQ ID NO: 957), AUGgugagcu (SEQ ID NO: 958), AUGgugaggc (SEQ ID NO: 959), AUGgugaggg (SEQ ID NO: 960), AUGgugagua (SEQ ID NO: 961), AUGgugaguc (SEQ ID NO: 962), AUGgugagug (SEQ ID NO: 963), AUGgugaguu (SEQ ID NO: 964), AUGgugauuu (SEQ ID NO: 965), AUGgugcgau (SEQ ID NO: 966), AUGgugcgug (SEQ ID NO: 967), AUGgugggua (SEQ ID NO: 968), AUGgugggug (SEQ ID NO: 969), AUGgugugguu (SEQ ID NO: 970), AUGgugguua (SEQ ID NO: 971), AUGguguaag (SEQ ID NO: 972), AUGgugugaa (SEQ ID NO: 973), AUGgugugua (SEQ ID NO: 974), AUGgugugug (SEQ ID NO: 975), AUGguuacuc (SEQ ID NO: 976), AUGguuagca (SEQ ID NO: 977), AUGguuaguc (SEQ ID NO: 978), AUGguuagug (SEQ ID NO: 979), AUGguuaguu (SEQ ID NO: 980), AUGguucagu (SEQ ID NO: 981), AUGguucguc (SEQ ID NO: 982), AUGguuggua (SEQ ID NO: 983), AUGguugguc (SEQ ID NO: 984), AUGguugguu (SEQ ID NO: 985), AUGguuguuu (SEQ ID NO: 986), AUGguuugca (SEQ ID NO: 987), AUGguuugua (SEQ ID NO: 988), AUUgcaagua (SEQ ID NO: 989), AUUguaaaua (SEQ ID NO: 990), AUUguaagau (SEQ ID NO: 991), AUUguaagca (SEQ ID NO: 992), AUUguaagga (SEQ ID NO: 993), AUUguaaggc (SEQ ID NO: 994), AUUguaagua (SEQ ID NO: 995), AUUguaaguc (SEQ ID NO: 996), AUUguaaguu (SEQ ID NO: 997), AUUguaauua (SEQ ID NO: 998), AUUguaauuu (SEQ ID NO: 999), AUUguacaaa (SEQ ID NO: 1000), AUUguaccuc (SEQ ID NO: 1001), AUUguacgug (SEQ ID NO: 1002), AUUguacuug (SEQ ID NO: 1003), AUUguaggua (SEQ ID NO: 1004), AUUguaugag (SEQ ID NO: 1005), AUUguaugua (SEQ ID NO: 1006), AUUgucuguu (SEQ ID NO: 1007), AUUgugagcu (SEQ ID NO: 1008), AUUgugagua (SEQ ID NO: 1009), AUUgugaguc (SEQ ID NO: 1010), AUUgugaguu (SEQ ID NO: 1011), AUUgugcgug (SEQ ID NO: 1012), AUUgugggug (SEQ ID NO: 1013), AUUguuagug (SEQ ID NO: 1014), CAAguaaaaa (SEQ ID NO: 1015), CAAguaaaua (SEQ ID NO: 1016), CAAguaaauc (SEQ ID NO: 1017), CAAguaaaug (SEQ ID NO: 1018), CAAguaaccc (SEQ ID NO: 1019), CAAguaacua (SEQ ID NO: 1020), CAAguaacug (SEQ ID NO: 1021), CAAguaagaa (SEQ ID NO: 1022), CAAguaagac (SEQ ID NO: 1023), CAAguaagau (SEQ ID NO: 1024), CAAguaaggu (SEQ ID NO: 1025), CAAguaagua (SEQ ID NO: 1026), CAAguaaguc (SEQ ID NO: 1027), CAAguaagug (SEQ ID NO: 1028), CAAguaaguu (SEQ ID NO: 1029), CAAguaaucc (SEQ ID NO: 1030), CAAguaaucu (SEQ ID NO: 1031), CAAguaauua (SEQ ID NO: 1032), CAAguaauuc (SEQ ID NO: 1033), CAAguaauug (SEQ ID NO: 1034), CAAguaauuu (SEQ ID NO: 1035), CAAguacaca (SEQ ID NO: 1036), CAAguacguu (SEQ ID NO: 1037), CAAguacuuu (SEQ ID NO: 1038), CAAguagcug (SEQ ID NO: 1039), CAAguaggau (SEQ ID NO: 1040), CAAguaggua (SEQ ID NO: 1041), CAAguagguc (SEQ ID NO: 1042), CAAguaggug (SEQ ID NO: 1043), CAAguagguu (SEQ ID NO: 1044), CAAguaguuu (SEQ ID NO: 1045), CAAguauaac (SEQ ID NO: 1046), CAAguauaug (SEQ ID NO: 1047), CAAguaucuu (SEQ ID NO: 1048), CAAguaugag (SEQ ID NO: 1049), CAAguaugua (SEQ ID NO: 1050), CAAguauguc (SEQ ID NO: 1051), CAAguaugug (SEQ ID NO: 1052), CAAguauguu (SEQ ID NO: 1053), CAAguauuga (SEQ ID NO: 1054), CAAguauuuc (SEQ ID NO: 1055), CAAgucagac (SEQ ID NO: 1056), CAAgucagua (SEQ ID NO: 1057), CAAgucuaua (SEQ ID NO: 1058), CAAgucugau (SEQ ID NO: 1059), CAAgugacuu (SEQ ID NO: 1060), CAAgugagaa (SEQ ID NO: 1061), CAAgugagac (SEQ ID NO: 1062), CAAgugagca (SEQ ID NO: 1063), CAAgugaggc (SEQ ID NO: 1064), CAAgugaggg (SEQ ID NO: 1065), CAAgugagua (SEQ ID NO: 1066), CAAgugaguc (SEQ ID NO: 1067), CAAgugagug (SEQ ID NO: 1068), CAAgugaucc (SEQ ID NO: 1069), CAAgugaucu (SEQ ID NO: 1070), CAAgugauuc (SEQ ID NO: 1071), CAAgugauug (SEQ ID NO: 1072), CAAgugauuu (SEQ ID NO: 1073), CAAgugccuu (SEQ ID NO: 1074), CAAguggua (SEQ ID NO: 1075), CAAgugggguc (SEQ ID NO: 1076), CAAgugggug (SEQ ID NO: 1077), CAAgugugag (SEQ ID NO: 1078), CAAguuaaaa (SEQ ID NO: 1079), CAAguuaagu (SEQ ID NO: 1080), CAAguuaauc (SEQ ID NO: 1081), CAAguuagaa (SEQ ID NO: 1082), CAAguuaguu (SEQ ID NO: 1083), CAAguucaag (SEQ ID NO: 1084), CAAguuccgu (SEQ ID NO: 1085), CAAguuggua (SEQ ID NO: 1086), CAAguuuagu (SEQ ID NO: 1087), CAAguuucca (SEQ ID NO: 1088), CAAguuuguu (SEQ ID NO: 1089), CACguaagag (SEQ ID NO: 1090), CACguaagca (SEQ ID NO: 1091), CACguaauug (SEQ ID NO: 1092), CACguaggac (SEQ ID NO: 1093), CACguaucga (SEQ ID NO: 1094), CACgucaguu (SEQ ID NO: 1095), CACgugagcu (SEQ ID NO: 1096), CACgugaguc (SEQ ID NO: 1097), CACgugagug (SEQ ID NO: 1098), CAGgcaagaa (SEQ ID NO: 1099), CAGgcaagac (SEQ ID NO: 1100), CAGgcaagag (SEQ ID NO: 1101), CAGgcaagga (SEQ ID NO: 1102), CAGgcaagua (SEQ ID NO: 1103), CAGgcaagug (SEQ ID NO: 1104), CAGgcaaguu (SEQ ID NO: 1105), CAGgcacgca (SEQ ID NO: 1106), CAGgcagagg (SEQ ID NO: 1107), CAGgcaggug (SEQ ID NO: 1108), CAGgcaucau (SEQ ID NO: 1109), CAGgcaugaa (SEQ ID NO: 1110), CAGgcaugag (SEQ ID NO: 1111), CAGgcaugca (SEQ ID NO: 1112), CAGgcaugcg (SEQ ID NO: 1113), CAGgcaugug (SEQ ID NO: 1114), CAGgcgagag (SEQ ID NO: 1115), CAGgcgccug (SEQ ID NO: 1116), CAGgcgugug (SEQ ID NO: 1117), CAGguaaaaa (SEQ ID NO: 1118), CAGguaaaag (SEQ ID NO: 1119), CAGguaaaca (SEQ ID NO: 1120), CAGguaaacc (SEQ ID NO: 1121), CAGguaaaga (SEQ ID NO: 1122), CAGguaaagc (SEQ ID NO: 1123), CAGguaaagu (SEQ ID NO: 1124), CAGguaaaua (SEQ ID NO: 1125), CAGguaaauc (SEQ ID NO: 1126), CAGguaaaug (SEQ ID NO: 1127), CAGguaaauu (SEQ ID NO: 1128), CAGguaacag (SEQ ID NO: 1129), CAGguaacau (SEQ ID NO: 1130), CAGguaacca (SEQ ID NO: 1131), CAGguaaccg (SEQ ID NO: 1132), CAGguaacgu (SEQ ID NO: 1133), CAGguaacua (SEQ ID NO: 1134), CAGguaacuc (SEQ ID NO: 1135), CAGguaacug (SEQ ID NO: 1136), CAGguaacuu (SEQ ID NO: 1137), CAGguaagaa (SEQ ID NO: 1138), CAGguaagac (SEQ ID NO: 1139), CAG-guaagag (SEQ ID NO: 1140), CAGguaagau (SEQ ID NO: 1141), CAGguaagcc (SEQ ID NO: 1142), CAGguaagga (SEQ ID NO: 1143), CAGguaaggc (SEQ ID NO: 1144), CAGguaaggg (SEQ ID NO: 1145), CAGguaaggu (SEQ ID NO: 1146), CAGguaagua (SEQ ID NO: 1147), CAG-guaagug (SEQ ID NO: 1148), CAGguaaguu (SEQ ID NO: 1149), CAGguaauaa (SEQ ID NO: 1150), CAGguaauau (SEQ ID NO: 1151), CAGguaaucc (SEQ ID NO: 1152), CAGguaaugc (SEQ ID NO: 1153), CAGguaaugg (SEQ ID NO: 1154), CAGguaaugu (SEQ ID NO: 1155), CAG-guaauua (SEQ ID NO: 1156), CAGguaauuc (SEQ ID NO: 1157), CAGguaauug (SEQ ID NO: 1158), CAGguaauuu (SEQ ID NO: 1159), CAGguacaaa (SEQ ID NO: 1160), CAGguacaag (SEQ ID NO: 1161), CAGguacaau (SEQ ID NO: 1162), CAGguacaca (SEQ ID NO: 1163), CAGguacacg (SEQ ID NO: 1164), CAGguacaga (SEQ ID NO: 1165), CAGguacagg (SEQ ID NO: 1166), CAGguacagu (SEQ ID NO: 1167), CAGguacaua (SEQ ID NO: 1168), CAGgua-caug (SEQ ID NO: 1169), CAGguacauu (SEQ ID NO: 1170), CAGguaccac (SEQ ID NO: 1171), CAGguaccca (SEQ ID NO: 1172), CAGguacccg (SEQ ID NO: 1173), CAGguacccu (SEQ ID NO: 1174), CAGguaccgc (SEQ ID NO: 1175), CAGguaccgg (SEQ ID NO: 1176), CAGguac-cuc (SEQ ID NO: 1177), CAGguaccug (SEQ ID NO: 1178), CAGguaccuu (SEQ ID NO: 1179), CAGguacgag (SEQ ID NO: 1180), CAGguacgca (SEQ ID NO: 1181), CAGguacgcc (SEQ ID NO: 1182), CAGguacggu (SEQ ID NO: 1183), CAGguacgua (SEQ ID NO: 1184), CAGguacgug (SEQ ID NO: 1185), CAGguacuaa (SEQ ID NO: 1186), CAGguac-uag (SEQ ID NO: 1187), CAGguacuau (SEQ ID NO: 1188), CAGguacucc (SEQ ID NO: 1189), CAGguacucu (SEQ ID NO: 1190), CAGguacuga (SEQ ID NO: 1191), CAGgua-cugc (SEQ ID NO: 1192), CAGguacugu (SEQ ID NO: 1193), CAGguacuua (SEQ ID NO: 1194), CAGguacuuu (SEQ ID NO: 1195), CAGguagaaa (SEQ ID NO: 1196), CAGguagaac (SEQ ID NO: 1197), CAGguagaag (SEQ ID NO: 1198), CAGguagaca (SEQ ID NO: 1199), CAGguagacc (SEQ ID NO: 1200), CAGguagaga (SEQ ID NO: 1201), CAGguagauu (SEQ ID NO: 1202), CAGguagcaa (SEQ ID NO: 1203), CAGguagcac (SEQ ID NO: 1204), CAG-guagcag (SEQ ID NO: 1205), CAGguagcca (SEQ ID NO: 1206), CAGguagcgu (SEQ ID NO: 1207), CAGguagcua (SEQ ID NO: 1208), CAGguagcuc (SEQ ID NO: 1209), CAGguagcug (SEQ ID NO: 1210), CAGguagcuu (SEQ ID NO: 1211), CAGguaggaa (SEQ ID NO: 1212), CAG-guaggac (SEQ ID NO: 1213), CAGguaggag (SEQ ID NO: 1214), CAGguaggca (SEQ ID NO: 1215), CAGguaggga (SEQ ID NO: 1216), CAGguagggc (SEQ ID NO: 1217), CAGguagggg (SEQ ID NO: 1218), CAGguagggu (SEQ ID NO: 1219), CAGguaggua (SEQ ID NO: 1220), CAGguag-guc (SEQ ID NO: 1221), CAGguaggug (SEQ ID NO: 1222), CAGguagguu (SEQ ID NO: 1223), CAGguaguaa (SEQ ID NO: 1224), CAGguaguau (SEQ ID NO: 1225), CAGgua-guca (SEQ ID NO: 1226), CAGguagucc (SEQ ID NO: 1227), CAGguaguga (SEQ ID NO: 1228), CAGguagugu (SEQ ID NO: 1229), CAGguaguuc (SEQ ID NO: 1230), CAGguaguug (SEQ ID NO: 1231), CAGguaguuu (SEQ ID NO: 1232), CAGguauaag (SEQ ID NO: 1233), CAG-guauaca (SEQ ID NO: 1234), CAGguauaga (SEQ ID NO: 1235), CAGguauauc (SEQ ID NO: 1236), CAGguauaug (SEQ ID NO: 1237), CAGguauauu (SEQ ID NO: 1238), CAGguaucag (SEQ ID NO: 1239), CAGguaucau (SEQ ID NO: 1240), CAGguauccu (SEQ ID NO: 1241), CAG-guaucga (SEQ ID NO: 1242), CAGguaucgc (SEQ ID NO: 1243), CAGguaucua (SEQ ID NO: 1244), CAGguaucug (SEQ ID NO: 1245), CAGguaucuu (SEQ ID NO: 1246), CAGguaugaa (SEQ ID NO: 1247), CAGguaugac (SEQ ID NO: 1248), CAGguaugag (SEQ ID NO: 1249), CAG-guaugau (SEQ ID NO: 1250), CAGguaugca (SEQ ID NO: 1251), CAGguaugcc (SEQ ID NO: 1252), CAGguaugcg (SEQ ID NO: 1253), CAGguaugcu (SEQ ID NO: 1254), CAGguaugga (SEQ ID NO: 1255), CAGguauggg (SEQ ID NO: 1256), CAGguauggu (SEQ ID NO: 1257), CAGguau-gua (SEQ ID NO: 1258), CAGguauguc (SEQ ID NO: 1259), CAGguaugug (SEQ ID NO: 1260), CAGguauguu (SEQ ID NO: 1261), CAGguauuau (SEQ ID NO: 1262), CAG-guauuca (SEQ ID NO: 1263), CAGguauucu (SEQ ID NO: 1264), CAGguauuga (SEQ ID NO: 1265), CAGguauugg (SEQ ID NO: 1266), CAGguauugu (SEQ ID NO: 1267), CAGguauuua (SEQ ID NO: 1268), CAGguauuuc (SEQ ID NO: 1269), CAGguauuug (SEQ ID NO: 1270), CAG-guauuuu (SEQ ID NO: 1271), CAGgucaaca (SEQ ID NO: 1272), CAGgucaaug (SEQ ID NO: 1273), CAGgucacgu (SEQ ID NO: 1274), CAGgucagaa (SEQ ID NO: 1275), CAGgucagac (SEQ ID NO: 1276), CAGgucagca (SEQ ID NO: 1277), CAGgucagcc (SEQ ID NO: 1278), CAGgu-cagcg (SEQ ID NO: 1279), CAGgucagga (SEQ ID NO: 1280), CAGgucagua (SEQ ID NO: 1281), CAGgucaguc (SEQ ID NO: 1282), CAGgucagug (SEQ ID NO: 1283), CAGgucaguu (SEQ ID NO: 1284), CAGgucaucc (SEQ ID NO: 1285), CAGgucaugc (SEQ ID NO: 1286), CAGgu-cauua (SEQ ID NO: 1287), CAGgucauuu (SEQ ID NO: 1288), CAGguccacc (SEQ ID NO: 1289), CAGguccacu (SEQ ID NO: 1290), CAGguccagu (SEQ ID NO: 1291), CAGguccauc (SEQ ID NO: 1292), CAGguccauu (SEQ ID NO: 1293), CAGgucccag (SEQ ID NO: 1294), CAGgucc-cug (SEQ ID NO: 1295), CAGguccuga (SEQ ID NO: 1296), CAGguccugc (SEQ ID NO: 1297), CAGguccugg (SEQ ID NO: 1298), CAGgucggcc (SEQ ID NO: 1299), CAGgucg-gug (SEQ ID NO: 1300), CAGgucguug (SEQ ID NO: 1301), CAGgucucuc (SEQ ID NO: 1302), CAGgucucuu (SEQ ID NO: 1303), CAGgucugag (SEQ ID NO: 1304), CAGgucugcc (SEQ ID NO: 1305), CAGgucugcg (SEQ ID NO: 1306), CAGgucugga (SEQ ID NO: 1307), CAGgu-cuggu (SEQ ID NO: 1308), CAGgucugua (SEQ ID NO: 1309), CAGgucuguc (SEQ ID NO: 1310), CAGgucugug (SEQ ID NO: 1311), CAGgucuguu (SEQ ID NO: 1312), CAGgucuucc (SEQ ID NO: 1313), CAGgucuuuc (SEQ ID NO: 1314), CAGgugaaag (SEQ ID NO: 1315), CAG-gugaaau (SEQ ID NO: 1316), CAGgugaaca (SEQ ID NO: 1317), CAGgugaaga (SEQ ID NO: 1318), CAGgugaagg (SEQ ID NO: 1319), CAGgugaaua (SEQ ID NO: 1320), CAGgugaauc (SEQ ID NO: 1321), CAGgugaauu (SEQ ID NO: 1322), CAGgugacaa (SEQ ID NO: 1323), CAGguga-cau (SEQ ID NO: 1324), CAGgugacca (SEQ ID NO: 1325), CAGgugaccc (SEQ ID NO: 1326), CAGgugaccg (SEQ ID NO: 1327), CAGgugaccu (SEQ ID NO: 1328), CAG-gugacgg (SEQ ID NO: 1329), CAGgugacua (SEQ ID NO: 1330), CAGgugacuc (SEQ ID NO: 1331), CAGgugacug (SEQ ID NO: 1332), CAGgugagaa (SEQ ID NO: 1333), CAGgugagac (SEQ ID NO: 1334), CAGgugagag (SEQ ID NO: 1335), CAGgugagau (SEQ ID NO: 1336), CAG-gugagca (SEQ ID NO: 1337), CAGgugagcc (SEQ ID NO: 1338), CAGgugagcg (SEQ ID NO: 1339), CAGgugagcu (SEQ ID NO: 1340), CAGgugagga (SEQ ID NO: 1341), CAGgugaggc (SEQ ID NO: 1342), CAGgugaggg (SEQ ID NO: 1343), CAGgugaggu (SEQ ID NO: 1344), CAGgugagua (SEQ ID NO: 1345), CAGgugaguc (SEQ ID NO: 1346), CAGgugagug (SEQ ID NO: 1347), CAGgugaguu (SEQ ID NO: 1348), CAGgugauaa (SEQ ID NO: 1349), CAGgugaucc (SEQ ID NO: 1350), CAGgugaucu (SEQ ID NO: 1351), CAGgugaugc (SEQ ID NO: 1352), CAGgugaugg (SEQ ID NO: 1353), CAGgugaugu (SEQ ID NO: 1354), CAGgugauua (SEQ ID NO: 1355), CAGgugauuc (SEQ ID NO: 1356), CAGgugauug (SEQ ID NO: 1357), CAGgugauuu (SEQ ID NO: 1358), CAGgugcaaa (SEQ ID NO: 1359), CAGgugcaag (SEQ ID NO: 1360), CAGgugcaca (SEQ ID NO: 1361), CAGgugcacg (SEQ ID NO: 1362), CAGgugcaga (SEQ ID NO: 1363), CAGgugcagg (SEQ ID NO: 1364), CAGgugcaua (SEQ ID NO: 1365), CAGgugcauc (SEQ ID NO: 1366), CAGgugcaug (SEQ ID NO: 1367), CAGgugccaa (SEQ ID NO: 1368), CAGgugccca (SEQ ID NO: 1369), CAGgugcccc (SEQ ID NO: 1370), CAGgugcccg (SEQ ID NO: 1371), CAGgugccua (SEQ ID NO: 1372), CAGgugccug (SEQ ID NO: 1373), CAGgugcgaa (SEQ ID NO: 1374), CAGgugcgca (SEQ ID NO: 1375), CAGgugcgcc (SEQ ID NO: 1376), CAGgugcgcg (SEQ ID NO: 1377), CAGgugcgga (SEQ ID NO: 1378), CAGgugcggu (SEQ ID NO: 1379), CAGgugcgua (SEQ ID NO: 1380), CAGgugcguc (SEQ ID NO: 1381), CAGgugcgug (SEQ ID NO: 1382), CAGgugcuag (SEQ ID NO: 1383), CAGgugcuau (SEQ ID NO: 1384), CAGgugcuca (SEQ ID NO: 1385), CAGgugcucc (SEQ ID NO: 1386), CAGgugcucg (SEQ ID NO: 1387), CAGgugcugc (SEQ ID NO: 1388), CAGgugcugg (SEQ ID NO: 1389), CAGgugcuua (SEQ ID NO: 1390), CAGgugcuuc (SEQ ID NO: 1391), CAGgugcuug (SEQ ID NO: 1392), CAGguggaac (SEQ ID NO: 1393), CAGguggaag (SEQ ID NO: 1394), CAGguggaau (SEQ ID NO: 1395), CAGguggaga (SEQ ID NO: 1396), CAGguggagu (SEQ ID NO: 1397), CAGguggauu (SEQ ID NO: 1398), CAGguggcca (SEQ ID NO: 1399), CAGguggcuc (SEQ ID NO: 1400), CAGguggcug (SEQ ID NO: 1401), CAGgugggaa (SEQ ID NO: 1402), CAGgugggac (SEQ ID NO: 1403), CAGgugggag (SEQ ID NO: 1404), CAGgugggau (SEQ ID NO: 1405), CAGgugggca (SEQ ID NO: 1406), CAGgugggcc (SEQ ID NO: 1407), CAGgugggcu (SEQ ID NO: 1408), CAGgugggga (SEQ ID NO: 1409), CAGgugggc (SEQ ID NO: 1410), CAGgugggg (SEQ ID NO: 1411), CAGgugggu (SEQ ID NO: 1412), CAGgugggua (SEQ ID NO: 1413), CAGguggguc (SEQ ID NO: 1414), CAGgugggug (SEQ ID NO: 1415), CAGguggguu (SEQ ID NO: 1416), CAGguggucu (SEQ ID NO: 1417), CAGguggugg (SEQ ID NO: 1418), CAGgugguug (SEQ ID NO: 1419), CAGguguaca (SEQ ID NO: 1420), CAGguguagg (SEQ ID NO: 1421), CAGguguauc (SEQ ID NO: 1422), CAGgugucac (SEQ ID NO: 1423), CAGgugucag (SEQ ID NO: 1424), CAGgugucca (SEQ ID NO: 1425), CAGguguccu (SEQ ID NO: 1426), CAGgugucua (SEQ ID NO: 1427), CAGgugucuc (SEQ ID NO: 1428), CAGgugucug (SEQ ID NO: 1429), CAGgugugaa (SEQ ID NO: 1430), CAGgugugac (SEQ ID NO: 1431), CAGgugugag (SEQ ID NO: 1432), CAGgugugau (SEQ ID NO: 1433), CAGgugugca (SEQ ID NO: 1434), CAGgugugcc (SEQ ID NO: 1435), CAGgugugcg (SEQ ID NO: 1436), CAGgugugcu (SEQ ID NO: 1437), CAGgugugga (SEQ ID NO: 1438), CAGguguggc (SEQ ID NO: 1439), CAGgugugua (SEQ ID NO: 1440), CAGguguguc (SEQ ID NO: 1441), CAGgugugug (SEQ ID NO: 1442), CAGguguguu (SEQ ID NO: 1443), CAGguguuua (SEQ ID NO: 1444), CAGguuaaaa (SEQ ID NO: 1445), CAGguuaaua (SEQ ID NO: 1446), CAGguuaauc (SEQ ID NO: 1447), CAGguuaccu (SEQ ID NO: 1448), CAGguuagaa (SEQ ID NO: 1449), CAGguuagag (SEQ ID NO: 1450), CAGguuagau (SEQ ID NO: 1451), CAGguuagcc (SEQ ID NO: 1452), CAGguuaggg (SEQ ID NO: 1453), CAGguuaggu (SEQ ID NO: 1454), CAGguuagua (SEQ ID NO: 1455), CAGguuaguc (SEQ ID NO: 1456), CAGguuagug (SEQ ID NO: 1457), CAGguuaguu (SEQ ID NO: 1458), CAGguuauca (SEQ ID NO: 1459), CAGguuaugu (SEQ ID NO: 1460), CAGguuauua (SEQ ID NO: 1461), CAGguuauug (SEQ ID NO: 1462), CAGguucaaa (SEQ ID NO: 1463), CAGguucaac (SEQ ID NO: 1464), CAGguucaag (SEQ ID NO: 1465), CAGguucaca (SEQ ID NO: 1466), CAGguucacg (SEQ ID NO: 1467), CAGguucagg (SEQ ID NO: 1468), CAGguucaug (SEQ ID NO: 1469), CAGguuccag (SEQ ID NO: 1470), CAGguuccca (SEQ ID NO: 1471), CAGguucccg (SEQ ID NO: 1472), CAGguucgaa (SEQ ID NO: 1473), CAGguucgag (SEQ ID NO: 1474), CAGguucuau (SEQ ID NO: 1475), CAGguucugc (SEQ ID NO: 1476), CAGguucuua (SEQ ID NO: 1477), CAGguucuuc (SEQ ID NO: 1478), CAGguucuuu (SEQ ID NO: 1479), CAGguugaac (SEQ ID NO: 1480), CAGguugaag (SEQ ID NO: 1481), CAGguugagu (SEQ ID NO: 1482), CAGguugaua (SEQ ID NO: 1483), CAGguuggag (SEQ ID NO: 1484), CAGguuggca (SEQ ID NO: 1485), CAGguuggcc (SEQ ID NO: 1486), CAGguugguc (SEQ ID NO: 1487), CAGguuggug (SEQ ID NO: 1488), CAGguugguu (SEQ ID NO: 1489), CAGguuguaa (SEQ ID NO: 1490), CAGguuguac (SEQ ID NO: 1491), CAGguuguau (SEQ ID NO: 1492), CAGguuguca (SEQ ID NO: 1493), CAGguuguga (SEQ ID NO: 1494), CAGguuguug (SEQ ID NO: 1495), CAGguuuaag (SEQ ID NO: 1496), CAGguuuacc (SEQ ID NO: 1497), CAGguuuagc (SEQ ID NO: 1498), CAGguuuagu (SEQ ID NO: 1499), CAGguuucuu (SEQ ID NO: 1500), CAGguuugaa (SEQ ID NO: 1501), CAGguuugag (SEQ ID NO: 1502), CAGguuugau (SEQ ID NO: 1503), CAGguuugcc (SEQ ID NO: 1504), CAGguuugcu (SEQ ID NO: 1505), CAGguuuggg (SEQ ID NO: 1506), CAGguuuggu (SEQ ID NO: 1507), CAGguuugua (SEQ ID NO: 1508), CAGguuugug (SEQ ID NO: 1509), CAGguuuguu (SEQ ID NO: 1510), CAGguuuucu (SEQ ID NO: 1511), CAGguuuugg (SEQ ID NO: 1512), CAGguuuuuc (SEQ ID NO: 1513), CAGguuuuuu (SEQ ID NO: 1514), CAUgcagguu (SEQ ID NO: 1515), CAUguaaaac (SEQ ID NO: 1516), CAUguaacua (SEQ ID NO: 1517), CAUguaagaa (SEQ ID NO: 1518), CAUguaagag (SEQ ID NO: 1519), CAUguaagau (SEQ ID NO: 1520), CAUguaagcc (SEQ ID NO: 1521), CAUguaagua (SEQ ID NO: 1522), CAUguaagug (SEQ ID NO: 1523), CAUguaaguu (SEQ ID NO: 1524), CAUguaauua (SEQ ID NO: 1525), CAUguacaua (SEQ ID NO: 1526), CAUguaccac (SEQ ID NO: 1527), CAUguacguu (SEQ ID NO: 1528), CAUguaggua (SEQ ID NO: 1529), CAUguaggug (SEQ ID NO: 1530), CAUguagguu (SEQ ID NO: 1531), CAUguaugaa (SEQ ID NO: 1532), CAUguaugua (SEQ ID NO: 1533), CAUguaugug (SEQ ID NO: 1534), CAUguauguu (SEQ ID NO: 1535), CAUgugagaa (SEQ ID NO: 1536), CAUgugagca (SEQ ID NO: 1537), CAUgugagcu (SEQ ID NO: 1538), CAUgugagua (SEQ ID NO: 1539), CAUgugaguc (SEQ ID NO: 1540), CAUgugagug (SEQ ID NO: 1541), CAUgugaguu (SEQ ID NO: 1542), CAUgugcgua (SEQ ID NO: 1543), CAUguggaa (SEQ ID NO: 1544), CAUguggguu (SEQ ID NO: 1545), CAUgugugug (SEQ ID NO: 1546), CAUguguguu (SEQ ID NO: 1547), CAUguuaaua (SEQ ID NO: 1548), CAUguuagcc (SEQ ID NO: 1549), CCAguaagau (SEQ ID NO: 1550), CCAguaagca (SEQ ID NO: 1551), CCAguaagcc (SEQ ID NO: 1552), CCAguaagcu (SEQ ID NO: 1553), CCAguaagga (SEQ ID NO: 1554), CCAguaagua (SEQ ID NO: 1555), CCAguaaguc (SEQ ID NO: 1556), CCAguaagug (SEQ ID NO: 1557), CCAguaaguu (SEQ ID NO: 1558), CCAguaauug (SEQ ID NO: 1559), CCAguacggg (SEQ ID NO: 1560), CCAguagguc (SEQ ID NO: 1561), CCAguauugu (SEQ ID NO: 1562), CCAgugaggc (SEQ ID NO: 1563), CCAgugagua (SEQ ID NO: 1564), CCAgugagug (SEQ ID NO: 1565), CCAguggguc (SEQ ID NO: 1566), CCAguuaguu (SEQ ID NO: 1567), CCAguugagu (SEQ ID NO: 1568), CCCguaagau (SEQ ID NO: 1569), CCCguauguc (SEQ ID NO: 1570), CCCguauguu (SEQ ID NO: 1571), CCCguccugc (SEQ ID NO: 1572), CCCgugagug (SEQ ID NO: 1573), CCGguaaaga (SEQ ID NO: 1574), CCGguaagau (SEQ ID NO: 1575), CCGguaagcc (SEQ ID NO: 1576), CCGguaagga (SEQ ID NO: 1577), CCGguaaggc (SEQ ID NO: 1578), CCGguaaugg (SEQ ID NO: 1579), CCGguacagu (SEQ ID NO: 1580), CCGguacuga (SEQ ID NO: 1581), CCGguauucc (SEQ ID NO: 1582), CCGgucagug (SEQ ID NO: 1583), CCGgugaaaa (SEQ ID NO: 1584), CCGgugagaa (SEQ ID NO: 1585), CCGgugaggg (SEQ ID NO: 1586), CCGgugagug (SEQ ID NO: 1587), CCGgugaguu (SEQ ID NO: 1588), CCGgugcgcg (SEQ ID NO: 1589), CCGgugggcg (SEQ ID NO: 1590), CCGguuggUc (SEQ ID NO: 1591), CCUguaaaug (SEQ ID NO: 1592), CCUguaaauu (SEQ ID NO: 1593), CCUguaagaa (SEQ ID NO: 1594), CCUguaagac (SEQ ID NO: 1595), CCUguaagag (SEQ ID NO: 1596), CCUguaagca (SEQ ID NO: 1597), CCUguaagcg (SEQ ID NO: 1598), CCUguaagga (SEQ ID NO: 1599), CCUguaaguu (SEQ ID NO: 1600), CCUguaggua (SEQ ID NO: 1601), CCUguaggug (SEQ ID NO: 1602), CCUguaucuu (SEQ ID NO: 1603), CCUguauggu (SEQ ID NO: 1604), CCUguaugug (SEQ ID NO: 1605), CCUgugagaa (SEQ ID NO: 1606), CCUgugagca (SEQ ID NO: 1607), CCUgugaggg (SEQ ID NO: 1608), CCUgugaguc (SEQ ID NO: 1609), CCUgugagug (SEQ ID NO: 1610), CCUgugaguu (SEQ ID NO: 1611), CCUguggcuc (SEQ ID NO: 1612), CCUgugggua (SEQ ID NO: 1613), CCUgugugua (SEQ ID NO: 1614), CCUguuagaa (SEQ ID NO: 1615), CGAguaaggg (SEQ ID NO: 1616), CGAguaaggu (SEQ ID NO: 1617), CGAguagcug (SEQ ID NO: 1618), CGAguaggug (SEQ ID NO: 1619), CGAguagguu (SEQ ID NO: 1620), CGAgugagca (SEQ ID NO: 1621), CGCguaagag (SEQ ID NO: 1622), CGGgcaggca (SEQ ID NO: 1623), CGGguaagcc (SEQ ID NO: 1624), CGGguaagcu (SEQ ID NO: 1625), CGGguaaguu (SEQ ID NO: 1626), CGGguaauuc (SEQ ID NO: 1627), CGGguaauuu (SEQ ID NO: 1628), CGGguacagu (SEQ ID NO: 1629), CGGguacggg (SEQ ID NO: 1630), CGGguaggag (SEQ ID NO: 1631), CGGguaggcc (SEQ ID NO: 1632), CGGguaggug (SEQ ID NO: 1633), CGGguauuua (SEQ ID NO: 1634), CGGgucugag (SEQ ID NO: 1635), CGGgugaccg (SEQ ID NO: 1636), CGGgugacuc (SEQ ID NO: 1637), CGGgugagaa (SEQ ID NO: 1638), CGGgugaggg (SEQ ID NO: 1639), CGGgugaggu (SEQ ID NO: 1640), CGGgugagua (SEQ ID NO: 1641), CGGgugagug (SEQ ID NO: 1642), CGGgugaguu (SEQ ID NO: 1643), CGGgugauuu (SEQ ID NO: 1644), CGGgugccuu (SEQ ID NO: 1645), CGGguggag (SEQ ID NO: 1646), CGGgugggug (SEQ ID NO: 1647), CGGgugggUu (SEQ ID NO: 1648), CGGgugugUc (SEQ ID NO: 1649), CGGgugugug (SEQ ID NO: 1650), CGGguguguu (SEQ ID NO: 1651), CGGguucaag (SEQ ID NO: 1652), CGGguucaug (SEQ ID NO: 1653), CGGguuugcu (SEQ ID NO: 1654), CGUguagggu (SEQ ID NO: 1655), CGUguaugca (SEQ ID NO: 1656), CGUguaugua (SEQ ID NO: 1657), CGUgucugua (SEQ ID NO: 1658), CGUgugagug (SEQ ID NO: 1659), CGUguuuucu (SEQ ID NO: 1660), CUAguaaaug (SEQ ID NO: 1661), CUAguaagcg (SEQ ID NO: 1662), CUAguaagcu (SEQ ID NO: 1663), CUAguaagua (SEQ ID NO: 1664), CUAguaaguc (SEQ ID NO: 1665), CUAguaagug (SEQ ID NO: 1666), CUAguaaguu (SEQ ID NO: 1667), CUAguaauuu (SEQ ID NO: 1668), CUAguaggua (SEQ ID NO: 1669), CUAguagguu (SEQ ID NO: 1670), CUAguaugua (SEQ ID NO: 1671), CUAguauguu (SEQ ID NO: 1672), CUAgugagua (SEQ ID NO: 1673), CUCguaagca (SEQ ID NO: 1674), CUCguaagug (SEQ ID NO: 1675), CUCguaaguu (SEQ ID NO: 1676), CUCguaucug (SEQ ID NO: 1677), CUCgucugug (SEQ ID NO: 1678), CUCgugaaua (SEQ ID NO: 1679), CUCgugagua (SEQ ID NO: 1680), CUCgugauua (SEQ ID NO: 1681), CUGguaaaaa (SEQ ID NO: 1682), CUGguaaaau (SEQ ID NO: 1683), CUGguaaacc (SEQ ID NO: 1684), CUGguaaacg (SEQ ID NO: 1685), CUGguaaagc (SEQ ID NO: 1686), CUGguaaaua (SEQ ID NO: 1687), CUGguaaauc (SEQ ID NO: 1688), CUGguaaaug (SEQ ID NO: 1689), CUGguaaauu (SEQ ID NO: 1690), CUGguaacac (SEQ ID NO: 1691), CUGguaacag (SEQ ID NO: 1692), CUGguaaccc (SEQ ID NO: 1693), CUGguaaccg (SEQ ID NO: 1694), CUGguaacug (SEQ ID NO: 1695), CUGguaacuu (SEQ ID NO: 1696), CUGguaagaa (SEQ ID NO: 1697), CUGguaagag (SEQ ID NO: 1698), CUGguaagau (SEQ ID NO: 1699), CUGguaagca (SEQ ID NO: 1700), CUGguaagcc (SEQ ID NO: 1701), CUGguaagcu (SEQ ID NO: 1702), CUGguaagga (SEQ ID NO: 1703), CUGguaaggc (SEQ ID NO: 1704), CUGguaaggg (SEQ ID NO: 1705), CUGguaaggu (SEQ ID NO: 1706), CUGguaagua (SEQ ID NO: 1707), CUGguaagug (SEQ ID NO: 1708), CUGguaaguu (SEQ ID NO: 1709), CUGguaauga (SEQ ID NO: 1710), CUGguaaugc (SEQ ID NO: 1711), CUGguaauuc (SEQ ID NO: 1712), CUGguaauuu (SEQ ID NO: 1713), CUGguacaac (SEQ ID NO: 1714), CUGguacaau (SEQ ID NO: 1715), CUGguacaga (SEQ ID NO: 1716), CUGguacaua (SEQ ID NO: 1717), CUGguacauu (SEQ ID NO: 1718), CUGguaccau (SEQ ID NO: 1719), CUGguacguu (SEQ ID NO: 1720), CUGguacuaa (SEQ ID NO: 1721), CUGguacuug (SEQ ID NO: 1722), CUGguacuuu (SEQ ID NO: 1723), CUGguagaga (SEQ ID NO: 1724), CUGguagaua (SEQ ID NO: 1725), CUGguagcgu (SEQ ID NO: 1726), CUGguaggau (SEQ ID NO: 1727), CUGguaggca (SEQ ID NO: 1728), CUGguaggua (SEQ ID NO: 1729), CUGguagguc (SEQ ID NO: 1730), CUGguaggug (SEQ ID NO: 1731), CUGguaucaa (SEQ ID NO: 1732), CUGguaugau (SEQ ID NO: 1733), CUGguauggc (SEQ ID NO: 1734), CUGguauggu (SEQ ID NO: 1735), CUGguaugua (SEQ ID NO: 1736), CUGguaugug (SEQ ID NO: 1737), CUGguauguu (SEQ ID NO: 1738), CUGguauuga (SEQ ID NO: 1739), CUGguauuuc (SEQ ID NO: 1740), CUGguauuuu (SEQ ID NO: 1741), CUGgucaaca (SEQ ID NO: 1742), CUGgucagag (SEQ ID NO: 1743), CUGgucccgc (SEQ ID NO: 1744), CUGgucggua (SEQ ID NO: 1745), CUGgucuggg (SEQ ID NO: 1746), CUGgugaagu (SEQ ID NO: 1747), CUGgugaaua (SEQ ID NO: 1748), CUGgugaauu (SEQ ID NO: 1749), CUGgugacua (SEQ ID NO: 1750), CUGgugagaa (SEQ ID NO: 1751), CUGgugagac (SEQ ID NO: 1752), CUGgugagca (SEQ ID NO: 1753), CUGgugagcu (SEQ ID NO: 1754), CUGgugagga (SEQ ID NO: 1755), CUGgugaggc (SEQ ID NO: 1756), CUGgugaggg (SEQ ID NO: 1757), CUGgugaggu (SEQ ID NO: 1758), CUGgugagua (SEQ ID NO: 1759), CUGgugaguc (SEQ ID NO: 1760), CUGgugagug (SEQ ID NO: 1761), CUGgugaguu (SEQ ID NO: 1762), CUGgugauua (SEQ ID NO: 1763), CUGgugauuu (SEQ ID NO: 1764), CUGgugcaga (SEQ ID NO: 1765), CUGgugcgcu (SEQ ID NO: 1766), CUGgugcgug (SEQ ID NO: 1767), CUGgugcuga (SEQ ID NO: 1768), CUGgugggag (SEQ ID NO: 1769), CUGgugggga (SEQ ID NO: 1770), CUGgugggua (SEQ ID NO: 1771), CUGguggguc (SEQ ID NO: 1772), CUGguggug (SEQ ID NO: 1773), CUGgugggUu (SEQ ID NO:

1774), CUGgugugaa (SEQ ID NO: 1775), CUGgugugca (SEQ ID NO: 1776), CUGgugugcu (SEQ ID NO: 1777), CUGguguggu (SEQ ID NO: 1778), CUGgugugug (SEQ ID NO: 1779), CUGguguguu (SEQ ID NO: 1780), CUGguuagcu (SEQ ID NO: 1781), CUGguuagug (SEQ ID NO: 1782), CUGguucgug (SEQ ID NO: 1783), CUGguuggcu (SEQ ID NO: 1784), CUGguuguuu (SEQ ID NO: 1785), CUGguuugua (SEQ ID NO: 1786), CUGguuuguc (SEQ ID NO: 1787), CUGguuugug (SEQ ID NO: 1788), CUUguaaaug (SEQ ID NO: 1789), CUUguaagcu (SEQ ID NO: 1790), CUUguaagga (SEQ ID NO: 1791), CUUguaaggc (SEQ ID NO: 1792), CUUguaagua (SEQ ID NO: 1793), CUUguaagug (SEQ ID NO: 1794), CUUguaaguu (SEQ ID NO: 1795), CUUguacguc (SEQ ID NO: 1796), CUUguacgug (SEQ ID NO: 1797), CUUguaggua (SEQ ID NO: 1798), CUUguagugc (SEQ ID NO: 1799), CUUguauagg (SEQ ID NO: 1800), CUUgucagua (SEQ ID NO: 1801), CUUgugagua (SEQ ID NO: 1802), CUUgugaguc (SEQ ID NO: 1803), CUUgugaguu (SEQ ID NO: 1804), CUUguggguu (SEQ ID NO: 1805), CUUgugugua (SEQ ID NO: 1806), CUUguuagug (SEQ ID NO: 1807), CUUguuugag (SEQ ID NO: 1808), GAAguaaaac (SEQ ID NO: 1809), GAAguaaagc (SEQ ID NO: 1810), GAAguaaagu (SEQ ID NO: 1811), GAAguaaaua (SEQ ID NO: 1812), GAAguaaauu (SEQ ID NO: 1813), GAAguaagaa (SEQ ID NO: 1814), GAAguaagcc (SEQ ID NO: 1815), GAAguaagcu (SEQ ID NO: 1816), GAAguaagga (SEQ ID NO: 1817), GAAguaagua (SEQ ID NO: 1818), GAAguaagug (SEQ ID NO: 1819), GAAguaaguu (SEQ ID NO: 1820), GAAguaauau (SEQ ID NO: 1821), GAAguaaugc (SEQ ID NO: 1822), GAAguaauua (SEQ ID NO: 1823), GAAguaauuu (SEQ ID NO: 1824), GAAguaccau (SEQ ID NO: 1825), GAAguacgua (SEQ ID NO: 1826), GAAguacguc (SEQ ID NO: 1827), GAAguaggca (SEQ ID NO: 1828), GAAguagguc (SEQ ID NO: 1829), GAAguauaaa (SEQ ID NO: 1830), GAAguaugcu (SEQ ID NO: 1831), GAAguaugug (SEQ ID NO: 1832), GAAguauguu (SEQ ID NO: 1833), GAAguauuaa (SEQ ID NO: 1834), GAAgucagug (SEQ ID NO: 1835), GAAgugagag (SEQ ID NO: 1836), GAAgugagcg (SEQ ID NO: 1837), GAAgugaggu (SEQ ID NO: 1838), GAAgugaguc (SEQ ID NO: 1839), GAAgugagug (SEQ ID NO: 1840), GAAgugaguu (SEQ ID NO: 1841), GAAgugauaa (SEQ ID NO: 1842), GAAgugauuc (SEQ ID NO: 1843), GAAgugcgug (SEQ ID NO: 1844), GAAguguggg (SEQ ID NO: 1845), GAAgugugüc (SEQ ID NO: 1846), GAAguuggug (SEQ ID NO: 1847), GACguaaagu (SEQ ID NO: 1848), GACguaagcu (SEQ ID NO: 1849), GACguaagua (SEQ ID NO: 1850), GACguaaugg (SEQ ID NO: 1851), GACguaugcc (SEQ ID NO: 1852), GACguauguu (SEQ ID NO: 1853), GACgugagcc (SEQ ID NO: 1854), GACgugagug (SEQ ID NO: 1855), GAGgcaaaug (SEQ ID NO: 1856), GAGgcaagag (SEQ ID NO: 1857), GAGgcaagua (SEQ ID NO: 1858), GAGgcaagug (SEQ ID NO: 1859), GAGgcaaguu (SEQ ID NO: 1860), GAGgcacgag (SEQ ID NO: 1861), GAGgcaggga (SEQ ID NO: 1862), GAGgcaugug (SEQ ID NO: 1863), GAGgcgaagg (SEQ ID NO: 1864), GAGguaaaaa (SEQ ID NO: 1865), GAGguaaaac (SEQ ID NO: 1866), GAGguaaaag (SEQ ID NO: 1867), GAGguaaaau (SEQ ID NO: 1868), GAGguaaacc (SEQ ID NO: 1869), GAGguaaaga (SEQ ID NO: 1870), GAGguaaagc (SEQ ID NO: 1871), GAGguaaagu (SEQ ID NO: 1872), GAGguaaaua (SEQ ID NO: 1873), GAGguaaauc (SEQ ID NO: 1874), GAGguaaaug (SEQ ID NO: 1875), GAGguaaauu (SEQ ID NO: 1876), GAGguaacaa (SEQ ID NO: 1877), GAGguaacag (SEQ ID NO: 1878), GAGguaacca (SEQ ID NO: 1879), GAGguaaccu (SEQ ID NO: 1880), GAGguaacuu (SEQ ID NO: 1881), GAGguaagaa (SEQ ID NO: 1882), GAGguaagag (SEQ ID NO: 1883), GAGguaagau (SEQ ID NO: 1884), GAGguaagca (SEQ ID NO: 1885), GAGguaagcc (SEQ ID NO: 1886), GAGguaagcg (SEQ ID NO: 1887), GAGguaagcu (SEQ ID NO: 1888), GAGguaagga (SEQ ID NO: 1889), GAGguaaggc (SEQ ID NO: 1890), GAGguaaggg (SEQ ID NO: 1891), GAGguaaggu (SEQ ID NO: 1892), GAGguaagua (SEQ ID NO: 1893), GAGguaaguc (SEQ ID NO: 1894), GAGguaauaa (SEQ ID NO: 1895), GAGguaauac (SEQ ID NO: 1896), GAGguaauau (SEQ ID NO: 1897), GAGguaauca (SEQ ID NO: 1898), GAGguaaucu (SEQ ID NO: 1899), GAGguaaugg (SEQ ID NO: 1900), GAGguaaugu (SEQ ID NO: 1901), GAGguaauug (SEQ ID NO: 1902), GAGguaauuu (SEQ ID NO: 1903), GAGguacaaa (SEQ ID NO: 1904), GAGguacaac (SEQ ID NO: 1905), GAGguacaga (SEQ ID NO: 1906), GAGguacagc (SEQ ID NO: 1907), GAGguacagu (SEQ ID NO: 1908), GAGguacaua (SEQ ID NO: 1909), GAGguacauu (SEQ ID NO: 1910), GAGguaccag (SEQ ID NO: 1911), GAGguaccga (SEQ ID NO: 1912), GAGguaccug (SEQ ID NO: 1913), GAGguaccuu (SEQ ID NO: 1914), GAGguacuag (SEQ ID NO: 1915), GAGguacuau (SEQ ID NO: 1916), GAGguacucc (SEQ ID NO: 1917), GAGguacugc (SEQ ID NO: 1918), GAGguacugg (SEQ ID NO: 1919), GAGguacugu (SEQ ID NO: 1920), GAGguacuug (SEQ ID NO: 1921), GAGguacuuu (SEQ ID NO: 1922), GAGguagaag (SEQ ID NO: 1923), GAGguagaga (SEQ ID NO: 1924), GAGguagagg (SEQ ID NO: 1925), GAGguagagu (SEQ ID NO: 1926), GAGguagauc (SEQ ID NO: 1927), GAGguagcua (SEQ ID NO: 1928), GAGguagcug (SEQ ID NO: 1929), GAGguaggaa (SEQ ID NO: 1930), GAGguaggag (SEQ ID NO: 1931), GAGguaggca (SEQ ID NO: 1932), GAGguaggcu (SEQ ID NO: 1933), GAGguaggga (SEQ ID NO: 1934), GAGguagggc (SEQ ID NO: 1935), GAGguagggg (SEQ ID NO: 1936), GAGguaggua (SEQ ID NO: 1937), GAGguaggug (SEQ ID NO: 1938), GAGguagguu (SEQ ID NO: 1939), GAGguaguaa (SEQ ID NO: 1940), GAGguaguag (SEQ ID NO: 1941), GAGguaguau (SEQ ID NO: 1942), GAGguagucu (SEQ ID NO: 1943), GAGguagugc (SEQ ID NO: 1944), GAGguagugg (SEQ ID NO: 1945), GAGguaguua (SEQ ID NO: 1946), GAGguaguug (SEQ ID NO: 1947), GAGguauaag (SEQ ID NO: 1948), GAGguauacu (SEQ ID NO: 1949), GAGguauagc (SEQ ID NO: 1950), GAGguauaug (SEQ ID NO: 1951), GAGguauauu (SEQ ID NO: 1952), GAGguaucau (SEQ ID NO: 1953), GAGguaucug (SEQ ID NO: 1954), GAGguaucuu (SEQ ID NO: 1955), GAGguaugaa (SEQ ID NO: 1956), GAGguaugac (SEQ ID NO: 1957), GAGguaugag (SEQ ID NO: 1958), GAGguaugcc (SEQ ID NO: 1959), GAGguaugcg (SEQ ID NO: 1960), GAGguaugcu (SEQ ID NO: 1961), GAGguaugga (SEQ ID NO: 1962), GAGguauggg (SEQ ID NO: 1963), GAGguauggu (SEQ ID NO: 1964), GAGguaugua (SEQ ID NO: 1965), GAGguauguc (SEQ ID NO: 1966), GAGguaugug (SEQ ID NO: 1967), GAGguauguu (SEQ ID NO: 1968), GAGguauucc (SEQ ID NO: 1969), GAGguauuga (SEQ ID NO: 1970), GAGguauugu (SEQ ID NO: 1971), GAGguauuua (SEQ ID NO: 1972), GAGguauuuc (SEQ ID NO: 1973), GAGguauuug (SEQ ID NO: 1974), GAGguauuuu (SEQ ID NO: 1975), GAGgucaaca (SEQ ID NO: 1976), GAGgucaagg (SEQ ID NO: 1977), GAGgucaaug (SEQ ID NO: 1978), GAGgucacug (SEQ ID NO: 1979), GAGgucagaa (SEQ ID NO: 1980), GAGgucagag (SEQ ID NO: 1981), GAGgucagcu (SEQ ID NO: 1982), GAGgucagga (SEQ ID NO: 1983), GAGgucaggc (SEQ ID NO: 1984), GAGgucaggg (SEQ ID NO: 1985), GAGgucaggu (SEQ ID NO: 1986), GAGgucagua (SEQ ID NO: 1987), GAGgucauau (SEQ ID NO: 1988), GAGgucaugu (SEQ ID NO: 1989), GAGgucauuu (SEQ ID NO: 1990), GAGguccaua (SEQ ID NO: 1991), GAGguccauc (SEQ ID NO: 1992), GAGguccggg (SEQ ID NO: 1993), GAGguccggu (SEQ ID NO: 1994), GAGguccuug (SEQ ID NO: 1995), GAGgucgggg (SEQ ID NO: 1996), GAGgucucgu (SEQ ID NO: 1997), GAGgucugag (SEQ ID NO: 1998), GAGgucuggu (SEQ ID NO: 1999), GAGgucuguc (SEQ ID NO: 2000), GAGgucuguu (SEQ ID NO: 2001), GAGgucuuuu (SEQ ID NO: 2002), GAGgugaaaa (SEQ ID NO: 2003), GAGgugaaau (SEQ ID NO: 2004), GAGgugaaca (SEQ ID NO: 2005), GAGgugaagg (SEQ ID NO: 2006), GAGgugaaua (SEQ ID NO: 2007), GAGgugaauu (SEQ ID NO: 2008), GAGgugacau (SEQ ID NO: 2009), GAGgugacca (SEQ ID NO: 2010), GAGgugaccu (SEQ ID NO: 2011), GAGgugacua (SEQ ID NO: 2012), GAGgugacuu (SEQ ID NO: 2013), GAGgugagaa (SEQ ID NO: 2014), GAGgugagac (SEQ ID NO: 2015), GAGgugagag (SEQ ID NO: 2016), GAGgugagau (SEQ ID NO: 2017), GAGgugagca (SEQ ID NO: 2018), GAGgugagcc (SEQ ID NO: 2019), GAGgugagcg (SEQ ID NO: 2020), GAGgugagcu (SEQ ID NO: 2021), GAGgugagga (SEQ ID NO: 2022), GAGgugaggc (SEQ ID NO: 2023), GAGgugaggg (SEQ ID NO: 2024), GAGgugagua (SEQ ID NO: 2025), GAGgugagug (SEQ ID NO: 2026), GAGgugaguu (SEQ ID NO: 2027), GAGgugauau (SEQ ID NO: 2028), GAGgugaucc (SEQ ID NO: 2029), GAGgugaucu (SEQ ID NO: 2030), GAGgugauga (SEQ ID NO: 2031), GAGgugaugg (SEQ ID NO: 2032), GAGgugaugu (SEQ ID NO: 2033), GAGgugauuc (SEQ ID NO: 2034), GAGgugcaca (SEQ ID NO: 2035), GAGgugcaga (SEQ ID NO: 2036), GAGgugcagc (SEQ ID NO: 2037), GAGgugcagg (SEQ ID NO: 2038), GAGgugccag (SEQ ID NO: 2039), GAGgugccca (SEQ ID NO: 2040), GAGgugccuu (SEQ ID NO: 2041), GAGgugcggg (SEQ ID NO: 2042), GAGgugcgug (SEQ ID NO: 2043), GAGgugcucc (SEQ ID NO: 2044), GAGgugcugg (SEQ ID NO: 2045), GAGgugcuua (SEQ ID NO: 2046), GAGgugcuug (SEQ ID NO: 2047), GAGguggaaa (SEQ ID NO: 2048), GAGguggaau (SEQ ID NO: 2049), GAGguggacc (SEQ ID NO: 2050), GAGguggacg (SEQ ID NO: 2051), GAGguggagg (SEQ ID NO: 2052), GAGguggcug (SEQ ID NO: 2053), GAGgugggaa (SEQ ID NO: 2054), GAGgugggag (SEQ ID NO: 2055), GAGgugggau (SEQ ID NO: 2056), GAGgugggca (SEQ ID NO: 2057), GAGgugggcg (SEQ ID NO: 2058), GAGgugggcu (SEQ ID NO: 2059), GAGguggggga (SEQ ID NO: 2060), GAGguggggc (SEQ ID NO: 2061), GAGgugggggg (SEQ ID NO: 2062), GAGgugggua (SEQ ID NO: 2063), GAGguggguc (SEQ ID NO: 2064), GAGgugggug (SEQ ID NO: 2065), GAGguggguu (SEQ ID NO: 2066), GAGgugguau (SEQ ID NO: 2067), GAGgugguuc (SEQ ID NO: 2068), GAGgugucau (SEQ ID NO: 2069), GAGgugugag (SEQ ID NO: 2070), GAGgugugau (SEQ ID NO: 2071), GAGgugugca (SEQ ID NO: 2072), GAGgugugcu (SEQ ID NO: 2073), GAGgugugga (SEQ ID NO: 2074), GAGguguggg (SEQ ID NO: 2075), GAGguguggu (SEQ ID NO: 2076), GAGgugugua (SEQ ID NO: 2077), GAGgugugug (SEQ ID NO: 2078), GAGguuaaau (SEQ ID NO: 2079), GAGguuaaga (SEQ ID NO: 2080), GAGguuaaua (SEQ ID NO: 2081), GAGguuaccg (SEQ ID NO: 2082), GAGguuagaa (SEQ ID NO: 2083), GAGguuagac (SEQ ID NO: 2084), GAGguuagag (SEQ ID NO: 2085), GAGguuaggu (SEQ ID NO: 2086), GAGguuagua (SEQ ID NO: 2087), GAGguuaguc (SEQ ID NO: 2088), GAGguuagug (SEQ ID NO: 2089), GAGguuaguu (SEQ ID NO: 2090), GAGguuaugu (SEQ ID NO: 2091), GAGguuauuc (SEQ ID NO: 2092), GAGguucaaa (SEQ ID NO: 2093), GAGguucaua (SEQ ID NO: 2094), GAGguucuga (SEQ ID NO: 2095), GAGguugaag (SEQ ID NO: 2096), GAGguugcag (SEQ ID NO: 2097), GAGguugcug (SEQ ID NO: 2098), GAGguuggaa (SEQ ID NO: 2099), GAGguuggag (SEQ ID NO: 2100), GAGguuggau (SEQ ID NO: 2101), GAGguuggua (SEQ ID NO: 2102), GAGguugguc (SEQ ID NO: 2103), GAGguugguu (SEQ ID NO: 2104), GAGguuguag (SEQ ID NO: 2105), GAGguuucug (SEQ ID NO: 2106), GAGguuugag (SEQ ID NO: 2107), GAGguuugga (SEQ ID NO: 2108), GAGguuuggg (SEQ ID NO: 2109), GAGguuugua (SEQ ID NO: 2110), GAGguuuguu (SEQ ID NO: 2111), GAGguuuuca (SEQ ID NO: 2112), GAGguuuuga (SEQ ID NO: 2113), GAGguuuugg (SEQ ID NO: 2114), GAGguuuuua (SEQ ID NO: 2115), GAGguuuuuc (SEQ ID NO: 2116), GAUguaaaau (SEQ ID NO: 2117), GAUguaagca (SEQ ID NO: 2118), GAUguaagcc (SEQ ID NO: 2119), GAUguaaggu (SEQ ID NO: 2120), GAUguaagua (SEQ ID NO: 2121), GAUguaagug (SEQ ID NO: 2122), GAUguaaguu (SEQ ID NO: 2123), GAUguacauc (SEQ ID NO: 2124), GAUguaggua (SEQ ID NO: 2125), GAUguauggc (SEQ ID NO: 2126), GAUguaugua (SEQ ID NO: 2127), GAUguauguu (SEQ ID NO: 2128), GAUgucagug (SEQ ID NO: 2129), GAUgugagag (SEQ ID NO: 2130), GAUgugagcc (SEQ ID NO: 2131), GAUgugagcu (SEQ ID NO: 2132), GAUgugagga (SEQ ID NO: 2133), GAUgugaguc (SEQ ID NO: 2134), GAUgugagug (SEQ ID NO: 2135), GAUgugaguu (SEQ ID NO: 2136), GAUguggggua (SEQ ID NO: 2137), GAUgugggug (SEQ ID NO: 2138), GAUguguguu (SEQ ID NO: 2139), GAUguuagcu (SEQ ID NO: 2140), GAUguucagu (SEQ ID NO: 2141), GAUguucgug (SEQ ID NO: 2142), GAUguuuguu (SEQ ID NO: 2143), GCAguaaagg (SEQ ID NO: 2144), GCAguaagaa (SEQ ID NO: 2145), GCAguaagga (SEQ ID NO: 2146), GCAguaagua (SEQ ID NO: 2147), GCAguaaguc (SEQ ID NO: 2148), GCAguaaguu (SEQ ID NO: 2149), GCAguagaug (SEQ ID NO: 2150), GCAguaggua (SEQ ID NO: 2151), GCAguaugug (SEQ ID NO: 2152), GCAguauguu (SEQ ID NO: 2153), GCAgucagua (SEQ ID NO: 2154), GCAgucagug (SEQ ID NO: 2155), GCAguccggu (SEQ ID NO: 2156), GCAgugacuu (SEQ ID NO: 2157), GCAgugagcc (SEQ ID NO: 2158), GCAgugagcg (SEQ ID NO: 2159), GCAgugagcu (SEQ ID NO: 2160), GCAgugagua (SEQ ID NO: 2161), GCAgugagug (SEQ ID NO: 2162), GCAgugaguu (SEQ ID NO: 2163), GCAgugggua (SEQ ID NO: 2164), GCAguuaagu (SEQ ID NO: 2165), GCAguugagu (SEQ ID NO: 2166), GCCguaaguc (SEQ ID NO: 2167), GCCgugagua (SEQ ID NO: 2168), GCGguaaagc (SEQ ID NO: 2169), GCGguaaaua (SEQ ID NO: 2170), GCGguaagcu (SEQ ID NO: 2171), GCGguaaggg (SEQ ID NO: 2172), GCGguaagug (SEQ ID NO: 2173), GCGguaauca (SEQ ID NO: 2174), GCGguacgua (SEQ ID NO: 2175), GCGguacuug (SEQ ID NO: 2176), GCGguagggu (SEQ ID NO: 2177), GCGguagugu (SEQ ID NO: 2178), GCGgugagca (SEQ ID NO: 2179), GCGgugagcu (SEQ ID NO: 2180), GCGgugaguu (SEQ ID NO: 2181), GCGguggcuc (SEQ ID NO: 2182), GCGgugugca (SEQ ID NO: 2183), GCGguguguu (SEQ ID NO: 2184), GCGguuaagu (SEQ ID NO: 2185), GCGguuugca (SEQ ID NO: 2186), GCUgcuguaa (SEQ ID NO: 2187), GCUguaaaua (SEQ ID NO: 2188), GCUguaagac (SEQ ID NO: 2189), GCUguaagag (SEQ ID NO: 2190), GCUguaagca (SEQ ID NO: 2191), GCUguaagga (SEQ ID NO: 2192), GCUguaagua (SEQ ID NO: 2193), GCUguaaguc (SEQ ID NO: 2194), GCUguaagug (SEQ ID NO: 2195), GCUguaaguu (SEQ ID NO: 2196), GCUguaggug (SEQ ID NO: 2197), GCUguauggu (SEQ ID NO: 2198), GCUgucagug (SEQ ID NO: 2199), GCUguccuug (SEQ ID NO: 2200), GCUgugagaa (SEQ ID NO: 2201), GCUgugagcc (SEQ ID NO:

2202), GCUgugagga (SEQ ID NO: 2203), GCUgugagua (SEQ ID NO: 2204), GCUgugaguc (SEQ ID NO: 2205), GCUgugagug (SEQ ID NO: 2206), GCUgugaguu (SEQ ID NO: 2207), GCUguggguu (SEQ ID NO: 2208), GGAguaagag (SEQ ID NO: 2209), GGAguaagca (SEQ ID NO: 2210), GGAguaagcc (SEQ ID NO: 2211), GGAguaagcu (SEQ ID NO: 2212), GGAguaagga (SEQ ID NO: 2213), GGAguaagug (SEQ ID NO: 2214), GGAguaaguu (SEQ ID NO: 2215), GGAguaauuu (SEQ ID NO: 2216), GGAguacugu (SEQ ID NO: 2217), GGAguaggaa (SEQ ID NO: 2218), GGAguaggua (SEQ ID NO: 2219), GGAguagguu (SEQ ID NO: 2220), GGAguaguau (SEQ ID NO: 2221), GGAguaugac (SEQ ID NO: 2222), GGAguauggu (SEQ ID NO: 2223), GGAgucaagu (SEQ ID NO: 2224), GGAgugaggg (SEQ ID NO: 2225), GGAgugagua (SEQ ID NO: 2226), GGAgugaguc (SEQ ID NO: 2227), GGAgugagug (SEQ ID NO: 2228), GGAgugaguu (SEQ ID NO: 2229), GGAgugcuuu (SEQ ID NO: 2230), GGAgugggca (SEQ ID NO: 2231), GGAgugggug (SEQ ID NO: 2232), GGAguuaagg (SEQ ID NO: 2233), GGAguugaga (SEQ ID NO: 2234), GGCguaagcc (SEQ ID NO: 2235), GGCguaggua (SEQ ID NO: 2236), GGCguaggug (SEQ ID NO: 2237), GGCgugagcc (SEQ ID NO: 2238), GGCgugaguc (SEQ ID NO: 2239), GGGguaaaca (SEQ ID NO: 2240), GGGguaaacc (SEQ ID NO: 2241), GGGguaaacu (SEQ ID NO: 2242), GGGguaagaa (SEQ ID NO: 2243), GGGguaagag (SEQ ID NO: 2244), GGGguaagau (SEQ ID NO: 2245), GGGguaagca (SEQ ID NO: 2246), GGGguaagcc (SEQ ID NO: 2247), GGGguaagcu (SEQ ID NO: 2248), GGGguaagga (SEQ ID NO: 2249), GGGguaaggg (SEQ ID NO: 2250), GGGguaagua (SEQ ID NO: 2251), GGGguaagug (SEQ ID NO: 2252), GGGguaaguu (SEQ ID NO: 2253), GGGguagaca (SEQ ID NO: 2254), GGGguaggag (SEQ ID NO: 2255), GGGguaggcc (SEQ ID NO: 2256), GGGguaggga (SEQ ID NO: 2257), GGGguaggua (SEQ ID NO: 2258), GGGguaggug (SEQ ID NO: 2259), GGGguagguu (SEQ ID NO: 2260), GGGguagugc (SEQ ID NO: 2261), GGGguaucug (SEQ ID NO: 2262), GGGguaugac (SEQ ID NO: 2263), GGGguaugga (SEQ ID NO: 2264), GGGguaugua (SEQ ID NO: 2265), GGGguauguc (SEQ ID NO: 2266), GGGguaugug (SEQ ID NO: 2267), GGGguauguu (SEQ ID NO: 2268), GGGgucagua (SEQ ID NO: 2269), GGGguccgug (SEQ ID NO: 2270), GGGgucggag (SEQ ID NO: 2271), GGGgucugug (SEQ ID NO: 2272), GGGgugaaca (SEQ ID NO: 2273), GGGgugaaga (SEQ ID NO: 2274), GGGgugagaa (SEQ ID NO: 2275), GGGgugagau (SEQ ID NO: 2276), GGGgugagcc (SEQ ID NO: 2277), GGGgugagcg (SEQ ID NO: 2278), GGGgugagcu (SEQ ID NO: 2279), GGGgugagga (SEQ ID NO: 2280), GGGgugaggc (SEQ ID NO: 2281), GGGgugaggg (SEQ ID NO: 2282), GGGgugaguc (SEQ ID NO: 2283), GGGgugagug (SEQ ID NO: 2284), GGGgugaguu (SEQ ID NO: 2285), GGGgugcgua (SEQ ID NO: 2286), GGGguggggu (SEQ ID NO: 2287), GGGgugggua (SEQ ID NO: 2288), GGGgugggug (SEQ ID NO: 2289), GGGguggguu (SEQ ID NO: 2290), GGGgugugcg (SEQ ID NO: 2291), GGGgugugua (SEQ ID NO: 2292), GGGguguguc (SEQ ID NO: 2293), GGGgugugug (SEQ ID NO: 2294), GGGguuacag (SEQ ID NO: 2295), GGGguuggac (SEQ ID NO: 2296), GGGguuggga (SEQ ID NO: 2297), GGGguuugcc (SEQ ID NO: 2298), GGGguuugua (SEQ ID NO: 2299), GGUguaagaa (SEQ ID NO: 2300), GGUguaagau (SEQ ID NO: 2301), GGUguaagca (SEQ ID NO: 2302), GGUguaagcc (SEQ ID NO: 2303), GGUguaagcg (SEQ ID NO: 2304), GGUguaaguc (SEQ ID NO: 2305), GGUguaagug (SEQ ID NO: 2306), GGUguagguc (SEQ ID NO: 2307), GGUguaggug (SEQ ID NO: 2308), GGUguagguu (SEQ ID NO: 2309), GGUguccgua (SEQ ID NO: 2310), GGUgugagag (SEQ ID NO: 2311), GGUgugagcc (SEQ ID NO: 2312), GGUgugagcu (SEQ ID NO: 2313), GGUgugagua (SEQ ID NO: 2314), GGUgugaguc (SEQ ID NO: 2315), GGUgugcuuc (SEQ ID NO: 2316), GGUguggcug (SEQ ID NO: 2317), GGUguggUga (SEQ ID NO: 2318), GGUgugucug (SEQ ID NO: 2319), GGUguugaaa (SEQ ID NO: 2320), GGUguugcug (SEQ ID NO: 2321), GUAguaagau (SEQ ID NO: 2322), GUAguaagua (SEQ ID NO: 2323), GUAguaagug (SEQ ID NO: 2324), GUAguagcuu (SEQ ID NO: 2325), GUAguaggua (SEQ ID NO: 2326), GUAgucagua (SEQ ID NO: 2327), GUAgugagua (SEQ ID NO: 2328), GUAguggugg (SEQ ID NO: 2329), GUAguuaagu (SEQ ID NO: 2330), GUAguuucug (SEQ ID NO: 2331), GUCguaagug (SEQ ID NO: 2332), GUCgugagug (SEQ ID NO: 2333), GUCgugaguu (SEQ ID NO: 2334), GUGgcaagua (SEQ ID NO: 2335), GUGgcuugua (SEQ ID NO: 2336), GUGguaaaau (SEQ ID NO: 2337), GUGguaaaga (SEQ ID NO: 2338), GUGguaaauu (SEQ ID NO: 2339), GUGguaacau (SEQ ID NO: 2340), GUGguaacua (SEQ ID NO: 2341), GUGguaagaa (SEQ ID NO: 2342), GUGguaagac (SEQ ID NO: 2343), GUGguaagag (SEQ ID NO: 2344), GUGguaagau (SEQ ID NO: 2345), GUGguaagca (SEQ ID NO: 2346), GUGguaagcg (SEQ ID NO: 2347), GUGguaagcu (SEQ ID NO: 2348), GUGguaagga (SEQ ID NO: 2349), GUGguaaggc (SEQ ID NO: 2350), GUGguaagua (SEQ ID NO: 2351), GUGguaaguc (SEQ ID NO: 2352), GUGguaagug (SEQ ID NO: 2353), GUGguaaguu (SEQ ID NO: 2354), GUGguaauga (SEQ ID NO: 2355), GUGguaauuc (SEQ ID NO: 2356), GUGguaauuu (SEQ ID NO: 2357), GUGguacaug (SEQ ID NO: 2358), GUGguacgau (SEQ ID NO: 2359), GUGguacuau (SEQ ID NO: 2360), GUGguacuug (SEQ ID NO: 2361), GUGguagaua (SEQ ID NO: 2362), GUGguagcgc (SEQ ID NO: 2363), GUGguaggga (SEQ ID NO: 2364), GUGguagguc (SEQ ID NO: 2365), GUGguaggug (SEQ ID NO: 2366), GUGguagguu (SEQ ID NO: 2367), GUGguauaaa (SEQ ID NO: 2368), GUGguaucuc (SEQ ID NO: 2369), GUGguaugaa (SEQ ID NO: 2370), GUGguaugau (SEQ ID NO: 2371), GUGguaugca (SEQ ID NO: 2372), GUGguaugua (SEQ ID NO: 2373), GUGguauguu (SEQ ID NO: 2374), GUGguccgug (SEQ ID NO: 2375), GUGgucuggc (SEQ ID NO: 2376), GUGgugaaac (SEQ ID NO: 2377), GUGgugagaa (SEQ ID NO: 2378), GUGgugagau (SEQ ID NO: 2379), GUGgugagca (SEQ ID NO: 2380), GUGgugagcu (SEQ ID NO: 2381), GUGgugagga (SEQ ID NO: 2382), GUGgugaggc (SEQ ID NO: 2383), GUGgugagug (SEQ ID NO: 2384), GUGgugaguu (SEQ ID NO: 2385), GUGgugauua (SEQ ID NO: 2386), GUGgugauuc (SEQ ID NO: 2387), GUGgugcgau (SEQ ID NO: 2388), GUGgugcuua (SEQ ID NO: 2389), GUGgugggaa (SEQ ID NO: 2390), GUGgugggua (SEQ ID NO: 2391), GUGguggguc (SEQ ID NO: 2392), GUGguguccg (SEQ ID NO: 2393), GUGguuagca (SEQ ID NO: 2394), GUGguuaggu (SEQ ID NO: 2395), GUGguuagug (SEQ ID NO: 2396), GUGguuugca (SEQ ID NO: 2397), GUGguuugua (SEQ ID NO: 2398), GUUguaaggu (SEQ ID NO: 2399), GUUguaagua (SEQ ID NO: 2400), GUUguaaguc (SEQ ID NO: 2401), GUUguaaguu (SEQ ID NO: 2402), GUUguaccac (SEQ ID NO: 2403), GUUguagcgu (SEQ ID NO: 2404), GUUguaugug (SEQ ID NO: 2405), GUUguauguu (SEQ ID NO: 2406), GUUgucugug (SEQ ID NO: 2407), GUUgugagcu (SEQ ID NO: 2408), GUUgugagug (SEQ ID NO: 2409), GUUgugaguu (SEQ ID NO: 2410), GUUgugggua (SEQ ID NO: 2411), GUUguggguu (SEQ ID NO: 2412), UAAguaaaug (SEQ ID NO: 2413), UAAguaacua (SEQ ID NO: 2414), UAAguaagaa (SEQ ID NO: 2415), UAAguaagag (SEQ ID NO: 2416), UAAguaagau (SEQ ID NO: 2417), UAAguaagca (SEQ ID NO: 2418), UAAguaagcu (SEQ ID NO: 2419), UAAguaagga (SEQ ID NO: 2420), UAAguaaggu (SEQ ID NO: 2421), UAAguaagua (SEQ ID NO: 2422), UAAguaaguc (SEQ ID NO: 2423), UAAguaagug (SEQ ID NO: 2424), UAAguaaguu (SEQ ID NO: 2425), UAAguaauaa (SEQ ID NO: 2426), UAAguacuag (SEQ ID NO: 2427), UAAguaguuu (SEQ ID NO: 2428), UAAguauaaa (SEQ ID NO: 2429), UAAguauaca (SEQ ID NO: 2430), UAAguaugua (SEQ ID NO: 2431), UAAguauuau (SEQ ID NO: 2432), UAAguauuuu (SEQ ID NO: 2433), UAAgucuuuu (SEQ ID NO: 2434), UAAgugagac (SEQ ID NO: 2435), UAAgugagga (SEQ ID NO: 2436), UAAgugaggg (SEQ ID NO: 2437), UAAgugagua (SEQ ID NO: 2438), UAAgugaguc (SEQ ID NO: 2439), UAAgugagug (SEQ ID NO: 2440), UAAgugaguu (SEQ ID NO: 2441), UAAgugaucc (SEQ ID NO: 2442), UAAgugauuc (SEQ ID NO: 2443), UAAgugcgug (SEQ ID NO: 2444), UAAguuaagu (SEQ ID NO: 2445), UAAguuccag (SEQ ID NO: 2446), UAAguucuuu (SEQ ID NO: 2447), UAAguuguaa (SEQ ID NO: 2448), UAAguuguau (SEQ ID NO: 2449), UAAguuuguu (SEQ ID NO: 2450), UACguaacug (SEQ ID NO: 2451), UACguaagaa (SEQ ID NO: 2452), UACguaagau (SEQ ID NO: 2453), UACguaagua (SEQ ID NO: 2454), UACguaagug (SEQ ID NO: 2455), UACguauccu (SEQ ID NO: 2456), UACgucuggc (SEQ ID NO: 2457), UACgugacca (SEQ ID NO: 2458), UAGgcaagac (SEQ ID NO: 2459), UAGgcaaguc (SEQ ID NO: 2460), UAGgcagguc (SEQ ID NO: 2461), UAGgcgugug (SEQ ID NO: 2462), UAGguaaaaa (SEQ ID NO: 2463), UAGguaaaac (SEQ ID NO: 2464), UAGguaaaag (SEQ ID NO: 2465), UAGguaaaau (SEQ ID NO: 2466), UAGguaaaca (SEQ ID NO: 2467), UAGguaaaga (SEQ ID NO: 2468), UAGguaaaua (SEQ ID NO: 2469), UAGguaaauc (SEQ ID NO: 2470), UAGguaaaug (SEQ ID NO: 2471), UAGguaaauu (SEQ ID NO: 2472), UAGguaacac (SEQ ID NO: 2473), UAGguaacag (SEQ ID NO: 2474), UAGguaacau (SEQ ID NO: 2475), UAGguaacca (SEQ ID NO: 2476), UAGguaacgg (SEQ ID NO: 2477), UAGguaacua (SEQ ID NO: 2478), UAGguaacuc (SEQ ID NO: 2479), UAGguaacug (SEQ ID NO: 2480), UAGguaacuu (SEQ ID NO: 2481), UAGguaagac (SEQ ID NO: 2482), UAGguaagag (SEQ ID NO: 2483), UAGguaagau (SEQ ID NO: 2484), UAGguaagca (SEQ ID NO: 2485), UAGguaagcc (SEQ ID NO: 2486), UAGguaagcu (SEQ ID NO: 2487), UAGguaagga (SEQ ID NO: 2488), UAGguaaggc (SEQ ID NO: 2489), UAGguaaggg (SEQ ID NO: 2490), UAGguaagua (SEQ ID NO: 2491), UAGguaaguc (SEQ ID NO: 2492), UAGguaagug (SEQ ID NO: 2493), UAGguaaguu (SEQ ID NO: 2494), UAGguaauag (SEQ ID NO: 2495), UAGguaauau (SEQ ID NO: 2496), UAGguaaucu (SEQ ID NO: 2497), UAGguaauga (SEQ ID NO: 2498), UAGguaaugg (SEQ ID NO: 2499), UAGguaaugu (SEQ ID NO: 2500), UAGguaauua (SEQ ID NO: 2501), UAGguaauuc (SEQ ID NO: 2502), UAGguaauuu (SEQ ID NO: 2503), UAGguacagc (SEQ ID NO: 2504), UAGguacagu (SEQ ID NO: 2505), UAGguacauu (SEQ ID NO: 2506), UAGguaccag (SEQ ID NO: 2507), UAGguaccua (SEQ ID NO: 2508), UAGguaccuu (SEQ ID NO: 2509), UAGguacgag (SEQ ID NO: 2510), UAGguacgua (SEQ ID NO: 2511), UAGguacguu (SEQ ID NO: 2512), UAGguacuau (SEQ ID NO: 2513), UAGguacuga (SEQ ID NO: 2514), UAGguacugg (SEQ ID NO: 2515), UAGguacuuc (SEQ ID NO: 2516), UAGguacuuu (SEQ ID NO: 2517), UAGguagcgg (SEQ ID NO: 2518), UAGguaggaa (SEQ ID NO: 2519), UAGguaggac (SEQ ID NO: 2520), UAGguaggau (SEQ ID NO: 2521), UAGguaggga (SEQ ID NO: 2522), UAGguagggg (SEQ ID NO: 2523), UAGguaggua (SEQ ID NO: 2524), UAGguagguc (SEQ ID NO: 2525), UAGguaggug (SEQ ID NO: 2526), UAGguagguu (SEQ ID NO: 2527), UAGguaguaa (SEQ ID NO: 2528), UAGguagucu (SEQ ID NO: 2529), UAGguagugg (SEQ ID NO: 2530), UAGguagugu (SEQ ID NO: 2531), UAGguaguuu (SEQ ID NO: 2532), UAGguauaaa (SEQ ID NO: 2533), UAGguauaac (SEQ ID NO: 2534), UAGguauaag (SEQ ID NO: 2535), UAGguauaau (SEQ ID NO: 2536), UAGguauaca (SEQ ID NO: 2537), UAGguauacu (SEQ ID NO: 2538), UAGguauaua (SEQ ID NO: 2539), UAGguauauc (SEQ ID NO: 2540), UAGguauauu (SEQ ID NO: 2541), UAGguaucag (SEQ ID NO: 2542), UAGguaucua (SEQ ID NO: 2543), UAGguaucuc (SEQ ID NO: 2544), UAGguaugaa (SEQ ID NO: 2545), UAGguaugag (SEQ ID NO: 2546), UAGguaugca (SEQ ID NO: 2547), UAGguaugga (SEQ ID NO: 2548), UAGguauggc (SEQ ID NO: 2549), UAGguauggu (SEQ ID NO: 2550), UAGguaugua (SEQ ID NO: 2551), UAGguauguc (SEQ ID NO: 2552), UAGguaugug (SEQ ID NO: 2553), UAGguauguu (SEQ ID NO: 2554), UAGguauuaa (SEQ ID NO: 2555), UAGguauuac (SEQ ID NO: 2556), UAGguauuau (SEQ ID NO: 2557), UAGguauuca (SEQ ID NO: 2558), UAGguauucc (SEQ ID NO: 2559), UAGguauucu (SEQ ID NO: 2560), UAGguauuga (SEQ ID NO: 2561), UAGguauuua (SEQ ID NO: 2562), UAGguauuuc (SEQ ID NO: 2563), UAGguauuuu (SEQ ID NO: 2564), UAGgucacuc (SEQ ID NO: 2565), UAGgucagcu (SEQ ID NO: 2566), UAGgucaggu (SEQ ID NO: 2567), UAGgucagua (SEQ ID NO: 2568), UAGgucagug (SEQ ID NO: 2569), UAGgucaguu (SEQ ID NO: 2570), UAGgucaucu (SEQ ID NO: 2571), UAGgucauug (SEQ ID NO: 2572), UAGguccaau (SEQ ID NO: 2573), UAGguccugu (SEQ ID NO: 2574), UAGgucucaa (SEQ ID NO: 2575), UAGgucucgc (SEQ ID NO: 2576), UAGgucuggc (SEQ ID NO: 2577), UAGgucuguc (SEQ ID NO: 2578), UAGgucugug (SEQ ID NO: 2579), UAGgugaagu (SEQ ID NO: 2580), UAGgugaaua (SEQ ID NO: 2581), UAGgugaaug (SEQ ID NO: 2582), UAGgugaauu (SEQ ID NO: 2583), UAGgugacau (SEQ ID NO: 2584), UAGgugacca (SEQ ID NO: 2585), UAGgugacua (SEQ ID NO: 2586), UAGgugagaa (SEQ ID NO: 2587), UAGgugagac (SEQ ID NO: 2588), UAGgugagag (SEQ ID NO: 2589), UAGgugagau (SEQ ID NO: 2590), UAGgugagcc (SEQ ID NO: 2591), UAGgugagcu (SEQ ID NO: 2592), UAGgugagga (SEQ ID NO: 2593), UAGgugaggc (SEQ ID NO: 2594), UAGgugaggu (SEQ ID NO: 2595), UAGgugagua (SEQ ID NO: 2596), UAGgugaguc (SEQ ID NO: 2597), UAGgugagug (SEQ ID NO: 2598), UAGgugauca (SEQ ID NO: 2599), UAGgugauuc (SEQ ID NO: 2600), UAGgugauuu (SEQ ID NO: 2601), UAGgugcaua (SEQ ID NO: 2602), UAGgugcauc (SEQ ID NO: 2603), UAGgugccgu (SEQ ID NO: 2604), UAGgugccug (SEQ ID NO: 2605), UAGgugcgca (SEQ ID NO: 2606), UAGgugcgua (SEQ ID NO: 2607), UAGgugcgug (SEQ ID NO: 2608), UAGgugcuga (SEQ ID NO: 2609), UAGguggaua (SEQ ID NO: 2610), UAGgugggaa (SEQ ID NO: 2611), UAGgugggac (SEQ ID NO: 2612), UAGgugggag (SEQ ID NO: 2613), UAGgugggau (SEQ ID NO: 2614), UAGgugggcc (SEQ ID NO: 2615), UAGgugggcu (SEQ ID NO: 2616), UAGguggguu (SEQ ID NO: 2617), UAGguggugu (SEQ ID NO: 2618), UAGguguaaa (SEQ ID NO: 2619), UAGgugugaa (SEQ ID NO: 2620), UAGgugugag (SEQ ID NO: 2621), UAGgugugca (SEQ ID NO: 2622), UAGgugugcc (SEQ ID NO: 2623), UAGgugugcg (SEQ ID NO: 2624), UAGguguggu (SEQ ID NO: 2625), UAGgugugua (SEQ ID NO: 2626), UAGgugugug (SEQ ID NO: 2627), UAGguguugg (SEQ ID NO: 2628), UAGguuaagc (SEQ ID NO: 2629), UAGguuagac (SEQ ID NO: 2630), UAGguuagcc (SEQ ID NO: 2631), UAGguuaggc (SEQ ID NO: 2632), UAGguuagua (SEQ ID NO: 2633), UAGguuaguc (SEQ ID NO: 2634), UAGguuagug (SEQ ID NO: 2635), UAGguucccc (SEQ ID NO: 2636), UAGguucuac (SEQ ID NO: 2637), UAGguuggua (SEQ ID NO: 2638), UAGguugguu (SEQ ID NO: 2639), UAGguugucc (SEQ ID NO: 2640), UAGguuuauu (SEQ ID NO: 2641), UAGguuugcc (SEQ ID NO: 2642), UAGguuugua (SEQ ID NO: 2643), UAGguuuguc (SEQ ID NO: 2644), UAGguuugug (SEQ ID NO: 2645), UAGguuuguu (SEQ ID NO: 2646), UAGguuuuuc (SEQ ID NO: 2647), UAGguuuuug (SEQ ID NO: 2648), UAUguaagaa (SEQ ID NO: 2649), UAUguaagau (SEQ ID NO: 2650), UAUguaagca (SEQ ID NO: 2651), UAUguaagcc (SEQ ID NO: 2652), UAUguaagua (SEQ ID NO: 2653), UAUguaaguc (SEQ ID NO: 2654), UAUguaagug (SEQ ID NO: 2655), UAUguaaguu (SEQ ID NO: 2656), UAUguacgug (SEQ ID NO: 2657), UAUguacguu (SEQ ID NO: 2658), UAUguagguc (SEQ ID NO: 2659), UAUguagguu (SEQ ID NO: 2660), UAUguauccu (SEQ ID NO: 2661), UAUguaucuc (SEQ ID NO: 2662), UAUguaugua (SEQ ID NO: 2663), UAUguauguc (SEQ ID NO: 2664), UAUguaugug (SEQ ID NO: 2665), UAUguauuau (SEQ ID NO: 2666), UAUgucagaa (SEQ ID NO: 2667), UAUgucugua (SEQ ID NO: 2668), UAUgugaaua (SEQ ID NO: 2669), UAUgugacag (SEQ ID NO: 2670), UAUgugagua (SEQ ID NO: 2671), UAUgugagug (SEQ ID NO: 2672), UAUgugaguu (SEQ ID NO: 2673), UAUgugggca (SEQ ID NO: 2674), UAUgugugua (SEQ ID NO: 2675), UAUguguuua (SEQ ID NO: 2676), UAUguuuugu (SEQ ID NO: 2677), UCAgcgacau (SEQ ID NO: 2678), UCAguaaaau (SEQ ID NO: 2679), UCAguaaaua (SEQ ID NO: 2680), UCAguaacug (SEQ ID NO: 2681), UCAguaagaa (SEQ ID NO: 2682), UCAguaagag (SEQ ID NO: 2683), UCAguaagau (SEQ ID NO: 2684), UCAguaagca (SEQ ID NO: 2685), UCAguaagcc (SEQ ID NO: 2686), UCAguaagcu (SEQ ID NO: 2687), UCAguaaggg (SEQ ID NO: 2688), UCAguaagua (SEQ ID NO: 2689), UCAguaaguc (SEQ ID NO: 2690), UCAguaagug (SEQ ID NO: 2691), UCAguaaguu (SEQ ID NO: 2692), UCAguaucuu (SEQ ID NO: 2693), UCAguaugga (SEQ ID NO: 2694), UCAguauggu (SEQ ID NO: 2695), UCAgucccca (SEQ ID NO: 2696), UCAgugagca (SEQ ID NO: 2697), UCAgugagcu (SEQ ID NO: 2698), UCAgugagua (SEQ ID NO: 2699), UCAgugagug (SEQ ID NO: 2700), UCAgugaguu (SEQ ID NO: 2701), UCAgugauug (SEQ ID NO: 2702), UCAguggugug (SEQ ID NO: 2703), UCAguugagc (SEQ ID NO: 2704), UCAguugauu (SEQ ID NO: 2705), UCAguuuagu (SEQ ID NO: 2706), UCCguaagca (SEQ ID NO: 2707), UCCguaagcu (SEQ ID NO: 2708), UCCguaaguc (SEQ ID NO: 2709), UCCguaagug (SEQ ID NO: 2710), UCCguaauag (SEQ ID NO: 2711), UCCguacuua (SEQ ID NO: 2712), UCCguaugua (SEQ ID NO: 2713), UCCguauguu (SEQ ID NO: 2714), UCCgugagau (SEQ ID NO: 2715), UCCgugaguc (SEQ ID NO: 2716), UCGguaaauu (SEQ ID NO: 2717), UCGguaagag (SEQ ID NO: 2718), UCGguaagcu (SEQ ID NO: 2719), UCGguacauc (SEQ ID NO: 2720), UCGguacucc (SEQ ID NO: 2721), UCGguagacc (SEQ ID NO: 2722), UCGguagguu (SEQ ID NO: 2723), UCGguaguaa (SEQ ID NO: 2724), UCGguaugug (SEQ ID NO: 2725), UCGguauguu (SEQ ID NO: 2726), UCGguauuga (SEQ ID NO: 2727), UCGgucagua (SEQ ID NO: 2728), UCGgucuuag (SEQ ID NO: 2729), UCGgugaagu (SEQ ID NO: 2730), UCGgugagaa (SEQ ID NO: 2731), UCGgugagca (SEQ ID NO: 2732), UCGgugaggc (SEQ ID NO: 2733), UCGgugagua (SEQ ID NO: 2734), UCGgugcgcu (SEQ ID NO: 2735), UCGgugcuuu (SEQ ID NO: 2736), UCGgugguuu (SEQ ID NO: 2737), UCGguuagcu (SEQ ID NO: 2738), UCUguaaaag (SEQ ID NO: 2739), UCUguaagaa (SEQ ID NO: 2740), UCUguaagau (SEQ ID NO: 2741), UCUguaagca (SEQ ID NO: 2742), UCUguaagcu (SEQ ID NO: 2743), UCUguaagua (SEQ ID NO: 2744), UCUguaaguc (SEQ ID NO: 2745), UCUguaagug (SEQ ID NO: 2746), UCUguaaguu (SEQ ID NO: 2747), UCUguaauaa (SEQ ID NO: 2748), UCUguaauga (SEQ ID NO: 2749), UCUguaaugu (SEQ ID NO: 2750), UCUguaggua (SEQ ID NO: 2751), UCUguagguu (SEQ ID NO: 2752), UCUguauaua (SEQ ID NO: 2753), UCUguaugac (SEQ ID NO: 2754), UCUguaugua (SEQ ID NO: 2755), UCUguccucg (SEQ ID NO: 2756), UCUgugagag (SEQ ID NO: 2757), UCUgugagcu (SEQ ID NO: 2758), UCUgugagga (SEQ ID NO: 2759), UCUgugagua (SEQ ID NO: 2760), UCUgugaguc (SEQ ID NO: 2761), UCUgugagug (SEQ ID NO: 2762), UCUgugaguu (SEQ ID NO: 2763), UCUgugcgua (SEQ ID NO: 2764), UCUgugugag (SEQ ID NO: 2765), UGAguaacuu (SEQ ID NO: 2766), UGAguaagau (SEQ ID NO: 2767), UGAguaagca (SEQ ID NO: 2768), UGAguaagcu (SEQ ID NO: 2769), UGAguaaggc (SEQ ID NO: 2770), UGAguaaggu (SEQ ID NO: 2771), UGAguaagua (SEQ ID NO: 2772), UGAguaaguc (SEQ ID NO: 2773), UGAguaagug (SEQ ID NO: 2774), UGAguaaguu (SEQ ID NO: 2775), UGAguaaucc (SEQ ID NO: 2776), UGAguaauua (SEQ ID NO: 2777), UGAguacagu (SEQ ID NO: 2778), UGAguacgua (SEQ ID NO: 2779), UGAguacguu (SEQ ID NO: 2780), UGAguacugu (SEQ ID NO: 2781), UGAguagcug (SEQ ID NO: 2782), UGAguaggua (SEQ ID NO: 2783), UGAguauaaa (SEQ ID NO: 2784), UGAguaugcu (SEQ ID NO: 2785), UGAguaugga (SEQ ID NO: 2786), UGAguaugua (SEQ ID NO: 2787), UGAguauguc (SEQ ID NO: 2788), UGAguauguu (SEQ ID NO: 2789), UGAgucagag (SEQ ID NO: 2790), UGAgucuacg (SEQ ID NO: 2791), UGAgugaaua (SEQ ID NO: 2792), UGAgugaauu (SEQ ID NO: 2793), UGAgugagaa (SEQ ID NO: 2794), UGAgugagau (SEQ ID NO: 2795), UGAgugagca (SEQ ID NO: 2796), UGAgugagcc (SEQ ID NO: 2797), UGAgugagga (SEQ ID NO: 2798), UGAgugagua (SEQ ID NO: 2799), UGAgugagug (SEQ ID NO: 2800), UGAgugaguu (SEQ ID NO: 2801), UGAgugggaa (SEQ ID NO: 2802), UGAguuaaga (SEQ ID NO: 2803), UGAguuaaug (SEQ ID NO: 2804), UGAguuacgg (SEQ ID NO: 2805), UGAguuaggu (SEQ ID NO: 2806), UGAguucuau (SEQ ID NO: 2807), UGAguugguu (SEQ ID NO: 2808), UGAguuguag (SEQ ID NO: 2809), UGAguuuauc (SEQ ID NO: 2810), UGCguaaguc (SEQ ID NO: 2811), UGCguaagug (SEQ ID NO: 2812), UGCguacggc (SEQ ID NO: 2813), UGCguacggg (SEQ ID NO: 2814), UGCguaugua (SEQ ID NO: 2815), UGGgcaaguc (SEQ ID NO: 2816), UGGgcaagug (SEQ ID NO: 2817), UGGgcacauc (SEQ ID NO: 2818), UGGgccacgu (SEQ ID NO: 2819), UGGgccccgg (SEQ ID NO: 2820), UGGguaaaau (SEQ ID NO: 2821), UGGguaaagc (SEQ ID NO: 2822), UGGguaaagg (SEQ ID NO: 2823), UGGguaaagu (SEQ ID NO: 2824), UGGguaaaua (SEQ ID NO: 2825), UGGguaaaug (SEQ ID NO: 2826), UGGguaaauu (SEQ ID NO: 2827), UGGguaacag (SEQ ID NO: 2828), UGGguaacau (SEQ ID NO: 2829), UGGguaacua (SEQ ID NO: 2830), UGGguaacuu (SEQ ID NO: 2831), UGGguaagaa (SEQ ID NO: 2832), UGGguaagac (SEQ ID NO: 2833), UGGguaagag (SEQ ID NO: 2834), UGGguaagau (SEQ ID NO: 2835), UGGguaagca (SEQ ID NO: 2836), UGGguaagcc (SEQ ID NO: 2837), UGGguaagcu (SEQ ID NO: 2838), UGGguaaggg (SEQ ID NO: 2839), UGGguaaggu (SEQ ID NO: 2840), UGGguaagua (SEQ ID NO: 2841), UGGguaaguc (SEQ ID NO: 2842), UGGguaagug (SEQ ID NO: 2843), UGGguaaguu (SEQ ID NO: 2844), UGGguaaugu (SEQ ID NO: 2845), UGGguaauua (SEQ ID NO: 2846), UGGguaauuu (SEQ ID NO: 2847), UGGguacaaa (SEQ ID NO: 2848), UGGguacagu (SEQ ID NO: 2849), UGGguacuac (SEQ ID NO: 2850), UGGguaggga (SEQ ID NO: 2851), UGGguagguc (SEQ ID NO: 2852), UGGguaggug (SEQ ID NO: 2853), UGGguagguu (SEQ ID NO: 2854), UGGguaguua (SEQ ID NO: 2855), UGGguauagu (SEQ ID NO: 2856), UGGguaugaa (SEQ ID NO: 2857), UGGguaugac (SEQ ID NO: 2858), UGGguaugag (SEQ ID NO: 2859), UGGguaugua (SEQ ID NO: 2860), UGGguauguc (SEQ ID NO: 2861), UGGguaugug (SEQ ID NO: 2862), UGGguauguu (SEQ ID NO: 2863), UGGguauuug (SEQ ID NO: 2864), UGGgucuuug (SEQ ID NO: 2865), UGGgugaccu (SEQ ID NO: 2866), UGGgugacua (SEQ ID NO: 2867), UGGgugagac (SEQ ID NO: 2868), UGGgugagag (SEQ ID NO: 2869), UGGgugagca (SEQ ID NO: 2870), UGGgugagcc (SEQ ID NO: 2871), UGGgugagga (SEQ ID NO: 2872), UGGgugaggc (SEQ ID NO: 2873), UGGgugaggg (SEQ ID NO: 2874), UGGgugagua (SEQ ID NO: 2875), UGGgugaguc (SEQ ID NO: 2876), UGGgugagug (SEQ ID NO: 2877), UGGgugaguu (SEQ ID NO: 2878), UGGgugcgug (SEQ ID NO: 2879), UGGguggagg (SEQ ID NO: 2880), UGGguggcuu (SEQ ID NO: 2881), UGGguggggg (SEQ ID NO: 2882), UGGgugggua (SEQ ID NO: 2883), UGGguggguc (SEQ ID NO: 2884), UGGgugggug (SEQ ID NO: 2885), UGGguggguu (SEQ ID NO: 2886), UGGgugugga (SEQ ID NO: 2887), UGGgugugc (SEQ ID NO: 2888), UGGgugugug (SEQ ID NO: 2889), UGGguguguu (SEQ ID NO: 2890), UGGguguuua (SEQ ID NO: 2891), UGGguuaaug (SEQ ID NO: 2892), UGGguuaguc (SEQ ID NO: 2893), UGGguuagug (SEQ ID NO: 2894), UGGguuaguu (SEQ ID NO: 2895), UGGguucaag (SEQ ID NO: 2896), UGGguucgua (SEQ ID NO: 2897), UGGguuggug (SEQ ID NO: 2898), UGGguuuaag (SEQ ID NO: 2899), UGGguuugua (SEQ ID NO: 2900), UGUgcaagua (SEQ ID NO: 2901), UGUguaaaua (SEQ ID NO: 2902), UGUguaagaa (SEQ ID NO: 2903), UGUguaagac (SEQ ID NO: 2904), UGUguaagag (SEQ ID NO: 2905), UGUguaaggu (SEQ ID NO: 2906), UGUguaagua (SEQ ID NO: 2907), UGUguaaguc (SEQ ID NO: 2908), UGUguaaguu (SEQ ID NO: 2909), UGUguacuuc (SEQ ID NO: 2910), UGUguaggcg (SEQ ID NO: 2911), UGUguaggua (SEQ ID NO: 2912), UGUguaguua (SEQ ID NO: 2913), UGUguaugug (SEQ ID NO: 2914), UGUgucagua (SEQ ID NO: 2915), UGUgucugua (SEQ ID NO: 2916), UGUgucuguc (SEQ ID NO: 2917), UGUgugaccc (SEQ ID NO: 2918), UGUgugagau (SEQ ID NO: 2919), UGUgugagca (SEQ ID NO: 2920), UGUgugagcc (SEQ ID NO: 2921), UGUgugagua (SEQ ID NO: 2922), UGUgugaguc (SEQ ID NO: 2923), UGUgugagug (SEQ ID NO: 2924), UGUgugcgug (SEQ ID NO: 2925), UGUgugggug (SEQ ID NO: 2926), UGUguggguu (SEQ ID NO: 2927), UGUgugugag (SEQ ID NO: 2928), UGUguguucu (SEQ ID NO: 2929), UGUguuuaga (SEQ ID NO: 2930), UUAguaaaua (SEQ ID NO: 2931), UUAguaagaa (SEQ ID NO: 2932), UUAguaagua (SEQ ID NO: 2933), UUAguaagug (SEQ ID NO: 2934), UUAguaaguu (SEQ ID NO: 2935), UUAguaggug (SEQ ID NO: 2936), UUAgugagca (SEQ ID NO: 2937), UUAgugaguu (SEQ ID NO: 2938), UUAguuaagu (SEQ ID NO: 2939), UUCguaaguc (SEQ ID NO: 2940), UUCguaaguu (SEQ ID NO: 2941), UUCguaauua (SEQ ID NO: 2942), UUCgugagua (SEQ ID NO: 2943), UUCgugaguu (SEQ ID NO: 2944), UUGgcaagug (SEQ ID NO: 2945), UUGgccgagu (SEQ ID NO: 2946), UUGguaaaaa (SEQ ID NO: 2947), UUGguaaaau (SEQ ID NO: 2948), UUGguaaaga (SEQ ID NO: 2949), UUGguaaagg (SEQ ID NO: 2950), UUGguaaagu (SEQ ID NO: 2951), UUGguaaauc (SEQ ID NO: 2952), UUGguaaaug (SEQ ID NO: 2953), UUGguaaauu (SEQ ID NO: 2954), UUGguaacug (SEQ ID NO: 2955), UUGguaacuu (SEQ ID NO: 2956), UUGguaagaa (SEQ ID NO: 2957), UUGguaagag (SEQ ID NO: 2958), UUGguaagcu (SEQ ID NO: 2959), UUGguaagga (SEQ ID NO: 2960), UUGguaaggg (SEQ ID NO: 2961), UUGguaagua (SEQ ID NO: 2962), UUGguaagug (SEQ ID NO: 2963), UUGguaaguu (SEQ ID NO: 2964), UUGguaauac (SEQ ID NO: 2965), UUGguaauca (SEQ ID NO: 2966), UUGguaaugc (SEQ ID NO: 2967), UUGguaaugu (SEQ ID NO: 2968), UUGguaauug (SEQ ID NO: 2969), UUGguaauuu (SEQ ID NO: 2970), UUGguacaua (SEQ ID NO: 2971), UUGguacgug (SEQ ID NO: 2972), UUGguagagg (SEQ ID NO: 2973), UUGguaggac (SEQ ID NO: 2974), UUGguaggcg (SEQ ID NO: 2975), UUGguaggcu (SEQ ID NO: 2976), UUGguaggga (SEQ ID NO: 2977), UUGguaggua (SEQ ID NO: 2978), UUGguagguc (SEQ ID NO: 2979), UUGguaggug (SEQ ID NO: 2980), UUGguauaaa (SEQ ID NO: 2981), UUGguauaca (SEQ ID NO: 2982), UUGguauauu (SEQ ID NO: 2983), UUGguaucua (SEQ ID NO: 2984), UUGguaucuc (SEQ ID NO: 2985), UUGguaugca (SEQ ID NO: 2986), UUGguaugua (SEQ ID NO: 2987), UUGguaugug (SEQ ID NO: 2988), UUGguauguu (SEQ ID NO: 2989), UUGguauugu (SEQ ID NO: 2990), UUGguauuua (SEQ ID NO: 2991), UUGguauuuu (SEQ ID NO: 2992), UUGgucagaa (SEQ ID NO: 2993), UUGgucagua (SEQ ID NO: 2994), UUGgucucug (SEQ ID NO: 2995), UUGgucugca (SEQ ID NO: 2996), UUGgugaaaa (SEQ ID NO: 2997), UUGgugacug (SEQ ID NO: 2998), UUGgugagac (SEQ ID NO: 2999), UUGgugagau (SEQ ID NO: 3000), UUGgugagca (SEQ ID NO: 3001), UUGgugagga (SEQ ID NO: 3002), UUGgugaggg (SEQ ID NO: 3003), UUGgugagua (SEQ ID NO: 3004), UUGgugaguc (SEQ ID NO: 3005), UUGgugagug (SEQ ID NO: 3006), UUGgugaguu (SEQ ID NO: 3007), UUGgugaugg (SEQ ID NO: 3008), UUGgugauua (SEQ ID NO: 3009), UUGgugauug (SEQ ID NO: 3010), UUGgugcaca (SEQ ID NO: 3011), UUGgugggaa (SEQ ID NO: 3012), UUGgugggc (SEQ ID NO: 3013), UUGgugggua (SEQ ID NO: 3014), UUGguggguc (SEQ ID NO: 3015), UUGgugggug (SEQ ID NO: 3016), UUGguggguu (SEQ ID NO: 3017), UUGgugguggu (SEQ ID NO: 3018), UUGgugugc (SEQ ID NO: 3019), UUGgugugug (SEQ ID NO: 3020), UUGguguguu (SEQ ID NO: 3021), UUGguuaagu (SEQ ID NO: 3022), UUGguuagca (SEQ ID NO: 3023), UUGguuagug (SEQ ID NO: 3024), UUGguuaguu (SEQ ID NO: 3025), UUGguuggga (SEQ ID NO: 3026), UUGguugguu (SEQ ID NO: 3027), UUGguuugua (SEQ ID NO: 3028), UUGguuuguc (SEQ ID NO: 3029), UUUgcaagug (SEQ ID NO: 3030), UUUguaaaua (SEQ ID NO: 3031), UUUguaaaug (SEQ ID NO: 3032), UUUguaagaa (SEQ ID NO: 3033), UUUguaagac (SEQ ID NO: 3034), UUUguaagag (SEQ ID NO: 3035), UUUguaagca (SEQ ID NO: 3036), UUUguaaggu (SEQ ID NO: 3037), UUUguaagua (SEQ ID NO: 3038), UUUguaaguc (SEQ ID NO: 3039), UUUguaagug (SEQ ID NO: 3040), UUUguaaguu (SEQ ID NO: 3041), UUUguaauuu (SEQ ID NO: 3042), UUUguacagg (SEQ ID NO: 3043), UUUguacgug (SEQ ID NO: 3044), UUUguacuag (SEQ ID NO: 3045), UUUguacugu (SEQ ID NO: 3046), UUUguagguu (SEQ ID NO: 3047), UUUguauccu (SEQ ID NO: 3048), UUUguauguu (SEQ ID NO: 3049), UUUgugagca (SEQ ID NO: 3050), UUUgugagug (SEQ ID NO: 3051), UUUgugcguc (SEQ ID NO: 3052), UUUguguguc (SEQ ID NO: 3053), and uGGguaccug (SEQ ID NO: 3054).

Additional exemplary gene sequences and splice site sequences (e.g., 5' splice site sequences) include AAGgcaagau (SEQ ID NO: 96), AUGguaugug (SEQ ID NO: 937), GGGgugaggc (SEQ ID NO: 2281), CAGguaggug (SEQ ID NO: 1222), AAGgucagua (SEQ ID NO: 293), AAGguuagag (SEQ ID NO: 3055), AUGgcacuua (SEQ ID NO: 3056), UAAguaaguc (SEQ ID NO: 2423), UGG-gugagcu (SEQ ID NO: 3057), CGAgcugggc (SEQ ID NO: 3058), AAAgcacccc (SEQ ID NO: 3059), UAGguggggg (SEQ ID NO: 3060), AGAguaacgu (SEQ ID NO: 3061), UCGgugaugu (SEQ ID NO: 3062), AAUgucaguu (SEQ ID NO: 516), AGGgucugag (SEQ ID NO: 3063), GAGgugacug (SEQ ID NO: 3064), AUGguagguu (SEQ ID NO: 3065), GAGgucuguc (SEQ ID NO: 2000), CAGguaugug (SEQ ID NO: 1260), CAAguacugc (SEQ ID NO: 3066), CACgugcgua (SEQ ID NO: 3067), CCGgugagcu (SEQ ID NO: 3068), CAGguacuuc (SEQ ID NO: 3069), CAGgcgagag (SEQ ID NO: 1115), GAAgcaagua (SEQ ID NO: 3070), AGGgugagca (SEQ ID NO: 789), CAGgcaaguc (SEQ ID NO: 3071), AAGgugaggc (SEQ ID NO: 344), CAGguaagua (SEQ ID NO: 1147), CCAguugggu (SEQ ID NO: 3072), AAGguguggg (SEQ ID NO: 3073), CAGguug-gag (SEQ ID NO: 1484), CCGguaugaa (SEQ ID NO: 3074), UGGguaaugu (SEQ ID NO: 2845), CAGgugaggu (SEQ ID NO: 1344), AGAguaauag (SEQ ID NO: 3075), CAG-guaugag (SEQ ID NO: 1249), AUGguaaguu (SEQ ID NO: 901), UUGgugggcc (SEQ ID NO: 3015), UUUguaagca (SEQ ID NO: 3036), CUCguaugcc (SEQ ID NO: 3076), UAGguaagag (SEQ ID NO: 2483), UAGgcaaguu (SEQ ID NO: 3077), GGAguuaagu (SEQ ID NO: 3078), GAG-guaugcc (SEQ ID NO: 1959), AAGguguggu (SEQ ID NO: 402), CAGguggggug (SEQ ID NO: 1415), UUAguaagua (SEQ ID NO: 2933), AAGguuggcu (SEQ ID NO: 3079), UGAguaugug (SEQ ID NO: 3080), CCAgccuucc (SEQ ID NO: 3081), CCUguacgug (SEQ ID NO: 3082), CCUguag-gua (SEQ ID NO: 1601), CAGguacgcu (SEQ ID NO: 3083), GAGguucuuc (SEQ ID NO: 3084), AAGguugccu (SEQ ID NO: 3085), CGUguucacu (SEQ ID NO: 3086), CGG-gugggga (SEQ ID NO: 3087), UAGgugggau (SEQ ID NO: 2614), CGGguaagga (SEQ ID NO: 3088), AAGguacuau (SEQ ID NO: 195), GGGguaagcu (SEQ ID NO: 2248), ACGguagagc (SEQ ID NO: 3089), CAGgugaaga (SEQ ID NO: 1318), GCGguaagag (SEQ ID NO: 3090), CAGgu-guugu (SEQ ID NO: 3091), GAAguuugug (SEQ ID NO: 3092), AUGgugagca (SEQ ID NO: 955), CGGguucgug (SEQ ID NO: 3093), AUUguccggc (SEQ ID NO: 3094), GAUgugugug (SEQ ID NO: 3095), AUGgucuguu (SEQ ID NO: 3096), AAGguaggau (SEQ ID NO: 219), CCGguaagau (SEQ ID NO: 1575), AAGguaaaga (SEQ ID NO: 126), GGGgugaguu (SEQ ID NO: 2285), AGGguuggug (SEQ ID NO: 808), GGAgugagug (SEQ ID NO: 2228), AGUguaagga (SEQ ID NO: 3097), UAGguaacug (SEQ ID NO: 2480), AAGgugaaga (SEQ ID NO: 3098), UGGguaagug (SEQ ID NO: 2843), CAGguaagag (SEQ ID NO: 1140), UAG-gugagcg (SEQ ID NO: 3099), GAGguaaaaa (SEQ ID NO: 1865), GCCguaaguu (SEQ ID NO: 3100), AAGguuuugu (SEQ ID NO: 473), CAGgugagga (SEQ ID NO: 1341), ACAgcccaug (SEQ ID NO: 3101), GCGgugagcc (SEQ ID NO: 3102), CAGguaugca (SEQ ID NO: 1251), AUGguac-cua (SEQ ID NO: 3103), CAAguaugua (SEQ ID NO: 1050), AUGgugggugc (SEQ ID NO: 3104), UAAguggcag (SEQ ID NO: 3105), UAGguauagu (SEQ ID NO: 3106), CUG-guauuua (SEQ ID NO: 3107), AGGguaaacg (SEQ ID NO: 3108), AUAguaagug (SEQ ID NO: 850), UUGguacuga (SEQ ID NO: 3109), GGUguaagcc (SEQ ID NO: 2303), GAGguggaua (SEQ ID NO: 3110), GAUguaagaa (SEQ ID NO: 3111), ACGgucaguu (SEQ ID NO: 3112), UAAguaaaca (SEQ ID NO: 3113), AAGguaucug (SEQ ID NO: 251), AGGguauuug (SEQ ID NO: 3114), AAGgugaaug (SEQ ID NO: 328), CUGgugaauu (SEQ ID NO: 1749), CAGguuuuuu (SEQ ID NO: 1514), CAUguaugug (SEQ ID NO: 1534), UUGguagagg (SEQ ID NO: 2973), AAGguaugcc (SEQ ID NO: 258), CAGgugccac (SEQ ID NO: 3115), UCGguauuga (SEQ ID NO: 2727), AAGguuugug (SEQ ID NO: 468), AAUguacagg (SEQ ID NO: 3116), CAUguggguu (SEQ ID NO: 1545), CAUgugaguu (SEQ ID NO: 1542), UUG-guaaugu (SEQ ID NO: 2968), AGUguaggug (SEQ ID NO: 3117), GAGguaacuc (SEQ ID NO: 3118), GAGguggcgc (SEQ ID NO: 3119), CUGguaauug (SEQ ID NO: 3120), GAGguuugcu (SEQ ID NO: 3121), UGUguacgug (SEQ ID NO: 3122), UAGguaaaga (SEQ ID NO: 2468), CUAguaggca (SEQ ID NO: 3123), UCUgugaguc (SEQ ID NO: 2761), UCUguaaggc (SEQ ID NO: 3124), CAGguuu-gug (SEQ ID NO: 1509), GAGguagggc (SEQ ID NO: 1935), AAGguaacca (SEQ ID NO: 3125), ACUgugaguu (SEQ ID NO: 646), UAGguaauag (SEQ ID NO: 2495), AAAguaagcu (SEQ ID NO: 17), AUGgugagug (SEQ ID NO: 963), UAGguuugug (SEQ ID NO: 2645), AACguaggac (SEQ ID NO: 3126), GUAgcaggua (SEQ ID NO: 3127), GAGgucagac (SEQ ID NO: 3128), AGGguaugaa (SEQ ID NO: 3129), GAGguuagug (SEQ ID NO: 2089), CAGgcacgug (SEQ ID NO: 3130), GGGgcaagac (SEQ ID NO: 3131), CAGgugugc (SEQ ID NO: 1441), CAG-guauuga (SEQ ID NO: 1265), CAGguauguc (SEQ ID NO: 1259), AAGgcaaggu (SEQ ID NO: 3132), UUGgugagaa (SEQ ID NO: 3133), AAGguaaaau (SEQ ID NO: 122), GGGguaagua (SEQ ID NO: 2251), AAGguaucuu (SEQ ID NO: 252), GACgugaguc (SEQ ID NO: 3134), UAUguaugcu (SEQ ID NO: 3135), AAGguacugu (SEQ ID NO: 199), CAGgugaacu (SEQ ID NO: 3136), CACguaaaug (SEQ ID NO: 3137), AAGgugugau (SEQ ID NO: 3138), GAAguauuug (SEQ ID NO: 3139), AAGgucugug (SEQ ID NO: 3140), AAGguggagg (SEQ ID NO: 3141), AAG-guauaug (SEQ ID NO: 244), CAGguucuua (SEQ ID NO: 1477), AGGguaacca (SEQ ID NO: 730), CAGgugucac (SEQ ID NO: 1423), AAAguucugu (SEQ ID NO: 3142), UUGgugaguu (SEQ ID NO: 3007), CAAgugaguc (SEQ ID NO: 1067), UAGguagguc (SEQ ID NO: 2525), GCG-gugagcu (SEQ ID NO: 2180), AUUgugagga (SEQ ID NO: 3143), CAGgugcaca (SEQ ID NO: 1361), CAGguuggaa (SEQ ID NO: 3144), CUGgucacuu (SEQ ID NO: 3145), GGAguaagug (SEQ ID NO: 2214), GAGgugggcu (SEQ ID NO: 2059), AAGguacuug (SEQ ID NO: 201), AGGguaggau (SEQ ID NO: 3146), AAUguguguu (SEQ ID NO: 3147), ACAguuaagu (SEQ ID NO: 568), GAGgugugug (SEQ ID NO: 2078), AAGgcgggcu (SEQ ID NO: 3148), AUAgca-agua (SEQ ID NO: 3149), AAGguuguua (SEQ ID NO: 454), CAAgcaaggc (SEQ ID NO: 3150), GUGguaauua (SEQ ID NO: 3151), UCUguucagu (SEQ ID NO: 3152), AGG-guaggcc (SEQ ID NO: 754), AAGguaucau (SEQ ID NO: 3153), UAGguaccuu (SEQ ID NO: 2509), AAGguaugac (SEQ ID NO: 254), GGAguaggua (SEQ ID NO: 2219), UAAguuggca (SEQ ID NO: 3154), AGUgugaggc (SEQ ID NO: 3155), GAGguuugug (SEQ ID NO: 3156), UGGgu-cugcu (SEQ ID NO: 3157), CAGgugaucc (SEQ ID NO: 1350), CAGgucagug (SEQ ID NO: 1283), AAGguaaggg (SEQ ID NO: 151), CAGgugcagu (SEQ ID NO: 3158), GAGgugggguc (SEQ ID NO: 2064), GCUgugagug (SEQ ID NO: 2206), AAGguggagu (SEQ ID NO: 3159), GGGgu-caguu (SEQ ID NO: 3160), AGCguaagug (SEQ ID NO: 719), AGAguaugaa (SEQ ID NO: 691), GGGguagggu (SEQ ID NO: 3161), AAGgccagca (SEQ ID NO: 3162), CGAguaugcc (SEQ ID NO: 3163), GUGgugagcg (SEQ ID NO: 3164), AAUguaaauu (SEQ ID NO: 481), CAGgugcgca (SEQ ID NO: 1375), GGUguaugaa (SEQ ID NO: 3165), CUUgugaguu (SEQ ID NO: 1804), AAGguaucuc (SEQ ID NO: 250), AGAguaagga (SEQ ID NO: 665), UAGguaagac (SEQ ID NO: 2482), GAGgugagug (SEQ ID NO: 2026), CAGguguguu (SEQ ID NO: 1443), UUGgugagua (SEQ ID NO: 3004), AGGgcgaguu (SEQ ID NO: 3166), CAG-guuuugc (SEQ ID NO: 3167), UUUgugaguu (SEQ ID NO: 3168), AGGguaagca (SEQ ID NO: 736), GAGguccucu (SEQ ID NO: 3169), CCAgcaggua (SEQ ID NO: 3170), GAGguucgcg (SEQ ID NO: 3171), CAGgugaucu (SEQ ID NO: 1351), ACUguaagua (SEQ ID NO: 625), AAGguaaauc (SEQ ID NO: 131), CAGgcaaaua (SEQ ID NO: 3172), GUGguaagca (SEQ ID NO: 2346), CAGguuaaau (SEQ ID NO: 3173), UUGguaauaa (SEQ ID NO: 3174), UAUguag-gua (SEQ ID NO: 3175), CAGguaguau (SEQ ID NO: 1225), AAGgugugcc (SEQ ID NO: 3176), UGGguaagag (SEQ ID NO: 2834), CAGgcaagca (SEQ ID NO: 3177), UUG-guaaggg (SEQ ID NO: 2961), AAGgcaggug (SEQ ID NO: 109), ACGguaaaug (SEQ ID NO: 3178), GCUgugagca (SEQ ID NO: 3179), AUGguacaca (SEQ ID NO: 3180), GUAguguguu (SEQ ID NO: 3181), ACUguaagag (SEQ ID NO: 3182), CCCgcagguc (SEQ ID NO: 3183), GAG-gugagcc (SEQ ID NO: 2019), GAGgugcugu (SEQ ID NO: 3184), UAAguaugcu (SEQ ID NO: 3185), GAGgccaucu (SEQ ID NO: 3186), UCAgugagug (SEQ ID NO: 2700), CAGgugcuac (SEQ ID NO: 3187), AAUgugggug (SEQ ID NO: 533), GAGgugugaa (SEQ ID NO: 3188), CUGguagguc (SEQ ID NO: 1730), GUGgcgcgcg (SEQ ID NO: 3189), CAGgugcaaa (SEQ ID NO: 1359), UAAguggagg (SEQ ID NO: 3190), CAUgugggua (SEQ ID NO: 3191), GAG-guagggu (SEQ ID NO: 3192), AAAgugaguu (SEQ ID NO: 61), AGGguucuag (SEQ ID NO: 3193), UGUgugagcu (SEQ ID NO: 3194), AGGgugaauc (SEQ ID NO: 3195), CAG-gucaggg (SEQ ID NO: 3196), AAGgucccug (SEQ ID NO: 3197), CUGguagagu (SEQ ID NO: 3198), UAGgucaguu (SEQ ID NO: 2570), AAAguaaggg (SEQ ID NO: 19), CAAguaugug (SEQ ID NO: 1052), CAGgugcuuu (SEQ ID NO: 3199), AAGguaauuc (SEQ ID NO: 169), GGGgugcacg (SEQ ID NO: 3200), ACUgugcuac (SEQ ID NO: 3201), CAGguaccua (SEQ ID NO: 3202), CAGguagcuu (SEQ ID NO: 1211), UGGgugaggc (SEQ ID NO: 2873), CUGgua-cauu (SEQ ID NO: 1718), AGGguaaucu (SEQ ID NO: 3203), CAGguacaag (SEQ ID NO: 1161), CAGguaauuc (SEQ ID NO: 1157), AGGgcacuug (SEQ ID NO: 3204), UAGgugagaa (SEQ ID NO: 2587), GAGguaaugc (SEQ ID NO: 3205), CCAgugaguu (SEQ ID NO: 3206), AAAguau-gug (SEQ ID NO: 44), CUGgugaauc (SEQ ID NO: 3207), UAUguaugua (SEQ ID NO: 2663), CCUgcaggug (SEQ ID NO: 3208), CAGguaucug (SEQ ID NO: 1245), GAG-gugaggu (SEQ ID NO: 3209), CUGguaaaac (SEQ ID NO: 3210), UGUgugugcu (SEQ ID NO: 3211), CAGguuaagu (SEQ ID NO: 3212), CAGguaaucc (SEQ ID NO: 1152), UAGguauuug (SEQ ID NO: 3213), UGGguagguc (SEQ ID NO: 2852), CAGguaacag (SEQ ID NO: 1129), AGCgugcgug (SEQ ID NO: 3214), AAGgucagga (SEQ ID NO: 289), GGUgugagcc (SEQ ID NO: 2312), CUGguaagua (SEQ ID NO: 1707), GGGgugggca (SEQ ID NO: 3215), AAGgugggaa (SEQ ID NO: 376), CAGgugagug (SEQ ID NO: 1347), CUGguuguua (SEQ ID NO: 3216), CAG-guaauag (SEQ ID NO: 3217), UAGgugaguu (SEQ ID NO: 3218), AGAguaaguu (SEQ ID NO: 671), UAGguaaucc (SEQ ID NO: 3219), CCGgugacug (SEQ ID NO: 3220), GUCgugauua (SEQ ID NO: 3221), CUUguaagug (SEQ ID NO: 1794), UAGguaguca (SEQ ID NO: 3222), CUGguaa-guc (SEQ ID NO: 3223), AGGgugagcg (SEQ ID NO: 3224), CAGguaugga (SEQ ID NO: 1255), AUUgugacca (SEQ ID NO: 3225), GUUgugggua (SEQ ID NO: 2411), AAGgua-caag (SEQ ID NO: 173), CUAgcaagug (SEQ ID NO: 3226), CUGgugagau (SEQ ID NO: 3227), CAGgugggca (SEQ ID NO: 1406), AUGgcucgag (SEQ ID NO: 3228), CUG-guacguu (SEQ ID NO: 1720), UUGgugugua (SEQ ID NO: 3229), GAGgugucug (SEQ ID NO: 3230), GAGgugggac (SEQ ID NO: 3231), GGGgugggag (SEQ ID NO: 3232), GCAgcgugag (SEQ ID NO: 3233), GAGguaaaga (SEQ ID NO: 1870), GAGguaugua (SEQ ID NO: 1965), AAGguga-gac (SEQ ID NO: 336), AAGguacaau (SEQ ID NO: 174), CUGguaugag (SEQ ID NO: 3234), AACguaaaau (SEQ ID NO: 3235), GUGguaggga (SEQ ID NO: 2364), CUGguau-gug (SEQ ID NO: 1737), CUUguaagca (SEQ ID NO: 3236), AAGguaggga (SEQ ID NO: 223), AUUguaagcc (SEQ ID NO: 3237), AUGguaagcu (SEQ ID NO: 895), CAGgugaauu (SEQ ID NO: 1322), UAGgugaaua (SEQ ID NO: 2581), CAAguaugga (SEQ ID NO: 3238), AUGguauggc (SEQ ID NO: 936), GAGgucaugc (SEQ ID NO: 3239), CAGguacccu (SEQ ID NO: 1174), ACAgugagac (SEQ ID NO: 3240), CAGgucugau (SEQ ID NO: 3241), GAAguugggu (SEQ ID NO: 3242), CUGgugcgug (SEQ ID NO: 1767), CAG-guacgag (SEQ ID NO: 1180), ACAgugagcc (SEQ ID NO: 556), AAGguaagua (SEQ ID NO: 153), GGAguaaggc (SEQ ID NO: 3243), GAGgugugua (SEQ ID NO: 2077), AAG-gucauuu (SEQ ID NO: 3244), CAGguagucu (SEQ ID NO: 3245), AUGguaucug (SEQ ID NO: 3246), AAGguaaacu (SEQ ID NO: 125), GAGguaggug (SEQ ID NO: 1938), CUGguaagca (SEQ ID NO: 1700), AGGguaagag (SEQ ID NO: 734), AAAguaaagc (SEQ ID NO: 3247), CAGguuugag (SEQ ID NO: 1502), GAGgcgggua (SEQ ID NO: 3248), CGAguacgau (SEQ ID NO: 3249), CAGguuguug (SEQ ID NO: 1495), AAAguauggg (SEQ ID NO: 3250), UAGgcug-guc (SEQ ID NO: 3251), AAGguaagga (SEQ ID NO: 149), AAGguuuccu (SEQ ID NO: 458), UUGguaaaac (SEQ ID NO: 3252), GAGguaagua (SEQ ID NO: 1893), CAGguu-caag (SEQ ID NO: 1465), UGGguuaugu (SEQ ID NO: 3253), GAGgugaguu (SEQ ID NO: 2027), ACGgugaaac (SEQ ID NO: 598), GAUguaacca (SEQ ID NO: 3254), AAGgugcggg (SEQ ID NO: 3255), CCGguacgug (SEQ ID NO: 3256), GAUgugagaa (SEQ ID NO: 3257), GUGgcg-guga (SEQ ID NO: 3258), CAGguauuag (SEQ ID NO: 3259), GAGguuggga (SEQ ID NO: 3260), AAGgcuagua (SEQ ID NO: 3261), AAGgugggcg (SEQ ID NO: 381), CAGgcaggga (SEQ ID NO: 3262), AAUguuaguu (SEQ ID NO: 3263), GAGguaaagg (SEQ ID NO: 3264), CAGgu-gugcu (SEQ ID NO: 1437), CUGguaugau (SEQ ID NO: 1733), AUGguuaguc (SEQ ID NO: 978), CUGgugagaa (SEQ ID NO: 1751), CAGgccggcg (SEQ ID NO: 3265), CAGgugacug (SEQ ID NO: 1332), AAAguaaggu (SEQ ID NO: 20), UAAguacuug (SEQ ID NO: 3266), AAGguaaagc (SEQ ID NO: 127), UCGguagggg (SEQ ID NO: 3267), CAGguaggaa (SEQ ID NO: 1212), AGUguaagca (SEQ ID NO: 817), CCCgugagau (SEQ ID NO: 3268), GUGguuguuu (SEQ ID NO: 3269), CAGguuugcc (SEQ ID NO: 1504), AGGguauggg (SEQ ID NO: 766), UAAguaagug (SEQ ID NO: 2424), GAGguaagac (SEQ ID NO: 3270), GAUguag-guc (SEQ ID NO: 3271), CAAguaggug (SEQ ID NO: 1043), AUAguaaaua (SEQ ID NO: 845), GAGguugggg (SEQ ID NO: 3272), GAGgcgagua (SEQ ID NO: 3273), CAG-guagugu (SEQ ID NO: 1229), GUGguaggug (SEQ ID NO: 2366), CAAgugagug (SEQ ID NO: 1068), AAGgugacaa (SEQ ID NO: 330), CCAgcguaau (SEQ ID NO: 3274), ACGgugaggu (SEQ ID NO: 3275), GGGguauauu (SEQ ID NO: 3276), CAGgugagua (SEQ ID NO: 1345), AAG-gugcgug (SEQ ID NO: 364), UAUguaaauu (SEQ ID NO: 3277), CAGgucagua (SEQ ID NO: 1281), ACGguacuua (SEQ ID NO: 3278), GAGgucagca (SEQ ID NO: 3279), UAAguaugua (SEQ ID NO: 2431), GGGgucagac (SEQ ID NO: 3280), AAUgugugag (SEQ ID NO: 3281), UCCgucagua (SEQ ID NO: 3282), CAGgugcuuc (SEQ ID NO: 1391), CCAguuagug (SEQ ID NO: 3283), CCGgugggcg (SEQ ID NO: 1590), AGGgugcaug (SEQ ID NO: 3284), GGGguaggau (SEQ ID NO: 3285), UAGgugggcc (SEQ ID NO: 2615), GAGguguucg (SEQ ID NO: 3286), UUGgcaagaa (SEQ ID NO: 3287), UCCguaagua (SEQ ID NO: 3288), CAGguguaag (SEQ ID NO: 3289), CUCgugagua (SEQ ID NO: 1680), GAGguguuuu (SEQ ID NO: 3290), GAGgugagca (SEQ ID NO: 2018), GAGguaaagu (SEQ ID NO: 1872), AAGguacguu (SEQ ID NO: 193), CAGguccagu (SEQ ID NO: 1291), AUGgugaaac (SEQ ID NO: 947), GUAgugagcu (SEQ ID NO: 3291), CAGgugaaaa (SEQ ID NO: 3292), AGGguacagg (SEQ ID NO: 3293), AAGguaacgc (SEQ ID NO: 3294), AAGguauacc (SEQ ID NO: 3295), CCUgugagau (SEQ ID NO: 3296), GGGguacgug (SEQ ID NO: 3297), GAGguauggu (SEQ ID NO: 1964), UAGguauuau (SEQ ID NO: 2557), GAAguaggag (SEQ ID NO: 3298), UCGguaaggg (SEQ ID NO: 3299), CCGguaagcg (SEQ ID NO: 3300), GAAguaauua (SEQ ID NO: 1823), CAGgugaguc (SEQ ID NO: 1346), AAGgucaaga (SEQ ID NO: 279), AUGguaaguc (SEQ ID NO: 899), CAGgugagcu (SEQ ID NO: 1340), CCAguuuuug (SEQ ID NO: 3301), CAGgugggag (SEQ ID NO: 1404), AAGguauuau (SEQ ID NO: 270), AAGguaaaua (SEQ ID NO: 130), AAGgugcugu (SEQ ID NO: 3302), AAAguacacc (SEQ ID NO: 3303), CUGguucgug (SEQ ID NO: 1783), UCAguaaguc (SEQ ID NO: 2690), GAAguacgug (SEQ ID NO: 3304), CAGgugacaa (SEQ ID NO: 1323), UGGguaagaa (SEQ ID NO: 2832), UGUguagggg (SEQ ID NO: 3305), GAGguaggca (SEQ ID NO: 1932), UUGgugaggc (SEQ ID NO: 3306), AUGgugugua (SEQ ID NO: 974), CAGguccucc (SEQ ID NO: 3307), UUGguaaaug (SEQ ID NO: 2953), GCUgugaguu (SEQ ID NO: 2207), AUGgucugua (SEQ ID NO: 3308), CAUgcaggug (SEQ ID NO: 3309), CUGguacacc (SEQ ID NO: 3310), CAGguccuua (SEQ ID NO: 3311), CAAguaaucu (SEQ ID NO: 1031), AUGgcagccu (SEQ ID NO: 3312), AAGgucagaa (SEQ ID NO: 282), AACgugaggc (SEQ ID NO: 3313), CAGgcacgca (SEQ ID NO: 1106), ACGguccagg (SEQ ID NO: 3314), UCUguacaua (SEQ ID NO: 3315), GAGgugauua (SEQ ID NO: 3316), ACGguaaaua (SEQ ID NO: 3317), AUGguaacug (SEQ ID NO: 3318), CAGgcgcguu (SEQ ID NO: 3319), CAGguauaga (SEQ ID NO: 1235), AAGguuuguu (SEQ ID NO: 3320), CAGguaugaa (SEQ ID NO: 1247), UAGguuggua (SEQ ID NO: 2638), CUGgugagac (SEQ ID NO: 1752), CAGguuagga (SEQ ID NO: 3321), AUGgugacug (SEQ ID NO: 3322), UUGguauccc (SEQ ID NO: 3323), CUUguaggac (SEQ ID NO: 3324), AAAguguguu (SEQ ID NO: 69), CAGguuucuu (SEQ ID NO: 1500), GGGguauggc (SEQ ID NO: 3325), GGGguaggac (SEQ ID NO: 3326), ACUguaaguc (SEQ ID NO: 626), AUCguaagcu (SEQ ID NO: 3327), UAGguucccc (SEQ ID NO: 2636), GGUgugagca (SEQ ID NO: 3328), CUGguuggua (SEQ ID NO: 3329), GGGguuaggg (SEQ ID NO: 3330), UGAguaagaa (SEQ ID NO: 3331), GAGguauucc (SEQ ID NO: 1969), UGGguuaguc (SEQ ID NO: 2893), CAGgcucgug (SEQ ID NO: 3332), UAGguagagu (SEQ ID NO: 3333), UAGgugcccu (SEQ ID NO: 3334), AAAgugagua (SEQ ID NO: 58), GAGguucaua (SEQ ID NO: 2094), UUGguaagag (SEQ ID NO: 2958), ACCgugugua (SEQ ID NO: 3335), UAUguaguau (SEQ ID NO: 3336), UGGguauag (SEQ ID NO: 3337), CAGgucugaa (SEQ ID NO: 3338), AAAguauaaa (SEQ ID NO: 3339), GUGgugaguc (SEQ ID NO: 3340), AGUgugauua (SEQ ID NO: 3341), UUGgugugug (SEQ ID NO: 3020), CAGgugaugg (SEQ ID NO: 1353), GCUgugagua (SEQ ID NO: 2204), CAGguacaug (SEQ ID NO: 1169), AAGguacagu (SEQ ID NO: 178), GAAguuguag (SEQ ID NO: 3342), CAGgugauua (SEQ ID NO: 1355), UAGgugaauu (SEQ ID NO: 2583), GGUguuaaua (SEQ ID NO: 3343), CAGguauuua (SEQ ID NO: 1268), CAAguacucg (SEQ ID NO: 3344), CAAguaagaa (SEQ ID NO: 1022), AAGguaccuu (SEQ ID NO: 188), ACGgugaggg (SEQ ID NO: 3345), UGAgcaggca (SEQ ID NO: 3346), GGGgugaccg (SEQ ID NO: 3347), GAGguaaaug (SEQ ID NO: 1875), CGGguuugug (SEQ ID NO: 3348), AAGgugagcg (SEQ ID NO: 341), GUGguaugga (SEQ ID NO: 3349), CUGguaagga (SEQ ID NO: 1703), GAGguaccag (SEQ ID NO: 1911), CCGgugagug (SEQ ID NO: 1587), AAGguuagaa (SEQ ID NO: 416), GAGguacuug (SEQ ID NO: 1921), AGAguaaaac (SEQ ID NO: 651), UCUgugagua (SEQ ID NO: 2760), AAGgcgggaa (SEQ ID NO: 3350), CAGguaugcg (SEQ ID NO: 1253), AGGguaaaac (SEQ ID NO: 3351), AAGgugacug (SEQ ID NO: 333), AGGguauguu (SEQ ID NO: 3352), AAGguaugua (SEQ ID NO: 263), CAGgucucuc (SEQ ID NO: 1302), CAGgcaugua (SEQ ID NO: 3353), CUGguaggua (SEQ ID NO: 1729), AAGgucaugc (SEQ ID NO: 3354), CAGguacaca (SEQ ID NO: 1163), GAUguacguu (SEQ ID NO: 3355), ACAguacgug (SEQ ID NO: 3356), ACGguaccca (SEQ ID NO: 3357), CAGguagugc (SEQ ID NO: 3358), ACAguaagag (SEQ ID NO: 3359), GGUgcacacc (SEQ ID NO: 3360), GAGguguaac (SEQ ID NO: 3361), AAGgugugua (SEQ ID NO: 403), UAGguacuua (SEQ ID NO: 3362), GCGguacugc (SEQ ID NO: 3363), UGGguaaguc (SEQ ID NO: 2842), CAUguaggua (SEQ ID NO: 1529), CAGguaggau (SEQ ID NO: 3364), CAGgucuggc (SEQ ID NO: 3365), GUGguuuuaa (SEQ ID NO: 3366), CAGgugggaa (SEQ ID NO: 1402), UGGgugagua (SEQ ID NO: 2875), CGAgugagcc (SEQ ID NO: 3367), AAGguauggc (SEQ ID NO: 261), AGUguuguca (SEQ ID NO: 3368), CAGgugauuu (SEQ ID NO: 1358), UAGguaucuc (SEQ ID NO: 2544), UAAguauguu (SEQ ID NO: 3369), AAGguugagc (SEQ ID NO: 3370), AGAguaaaga (SEQ ID NO: 653), GGUguaagua (SEQ ID NO: 3371), GGGgugagcu (SEQ ID NO: 2279), CAGguauaau (SEQ ID NO: 3372), GAGguacaaa (SEQ ID NO: 1904), AUGguaccaa (SEQ ID NO: 3373), UAGguagggg (SEQ ID NO: 2523), UGAgucagaa (SEQ ID NO: 3374), AAGgcaauua (SEQ ID NO: 3375), UUGguaagau (SEQ ID NO: 3376), CAGguacaga (SEQ ID NO: 1165), AGAguuagag (SEQ ID NO: 3377), CAGgugcguc (SEQ ID NO: 1381), GAGguauuac (SEQ ID NO: 3378), ACGguacaga (SEQ ID NO: 3379), CAGgucuucc (SEQ ID NO: 1313), AAGguaaggu (SEQ ID NO: 152), GAGguaauuu (SEQ ID NO: 1903), AGUguaggcu (SEQ ID NO: 3380), AAAguaagcg (SEQ ID NO: 3381), CCUguaagcc (SEQ ID NO: 3382), AGGgugauuu (SEQ ID NO: 3383), UGUguaugaa (SEQ ID NO: 3384), CUGguacaca (SEQ ID NO: 3385), AGGguagaga (SEQ ID NO: 3386), AUAguaagca (SEQ ID NO: 848), AGAguaugua (SEQ ID NO: 3387), UUGgucagca (SEQ ID NO: 3388), CAGgcaaguu (SEQ ID NO: 1105), AAGguauaua (SEQ ID NO: 242), AAGgucugga (SEQ ID NO: 314), CAGguacgca (SEQ ID NO: 1181), AGGgugcggg (SEQ ID NO: 3389), AUGguaagug (SEQ ID NO: 900), AAAgugauga (SEQ ID NO: 3390), UGCgugagua (SEQ ID NO: 3391), AGAguaggga (SEQ ID NO: 684), UGUguaggua (SEQ ID NO: 2912), UAGguaggau (SEQ ID NO: 2521), UAAgugagug (SEQ ID NO: 2440), GCUguaagua (SEQ ID NO: 2193), GAAguaagaa (SEQ ID NO: 1814), UCGgugaggc (SEQ ID NO: 2733), UAGguauuuu (SEQ ID NO: 2564), AAGguacaca (SEQ ID NO: 3392), AAGguaggua (SEQ ID NO: 227), UGGguagguu (SEQ ID NO: 2854), ACAgcaagua (SEQ ID NO: 541), GAGguaggag (SEQ ID NO: 1931), UGGgugaguu (SEQ ID NO: 2878), GCGgugagau (SEQ ID NO: 3393), CCUguagguu (SEQ ID NO: 3394), CAGgugugua (SEQ ID NO: 1440), CUGguaagcc (SEQ ID NO: 1701), AAGgugauuc (SEQ ID NO: 3395), CAGguagcua (SEQ ID NO: 1208), GUUguaagug (SEQ ID NO: 3396), AUGguaagca (SEQ ID NO: 893), AUAguaggga (SEQ ID NO: 3397), GGGguucgcu (SEQ ID NO: 3398), CCGgucagag (SEQ ID NO: 3399), GUAguaugag (SEQ ID NO: 3400), CGUguaagau (SEQ ID NO: 3401), UGAguaggca (SEQ ID NO: 3402), UCAguaugua (SEQ ID NO: 3403), GAGguaucug (SEQ ID NO: 1954), AGAguauuuu (SEQ ID NO: 3404), AAGguuguag (SEQ ID NO: 3405), AGUguaaguu (SEQ ID NO: 821), CGGguaaguu (SEQ ID NO: 1626), UCGgugcgga (SEQ ID NO: 3406), UAGguaagua (SEQ ID NO: 2491), GAAguuagau (SEQ ID NO: 3407), GCUgugagac (SEQ ID NO: 3408), CAGgcaggua (SEQ ID NO: 3409), CAGguagggg (SEQ ID NO: 1218), UAAguuaaga (SEQ ID NO: 3410), AUGguggguu (SEQ ID NO: 970), UAGguaaguu (SEQ ID NO: 2494), CUGguaaauu (SEQ ID NO: 1690), CCGguaagga (SEQ ID NO: 1577), GAGgcaggca (SEQ ID NO: 3411), CAUguaagug (SEQ ID NO: 1523), AAGgugccua (SEQ ID NO: 3412), UUGguaggga (SEQ ID NO: 2977), AAGguaaaca (SEQ ID NO: 123), CGGgugugag (SEQ ID NO: 3413), GGGgugugag (SEQ ID NO: 3414), UCCgugggue (SEQ ID NO: 3415), ACGguaaauc (SEQ ID NO: 3416), UCAguaggua (SEQ ID NO: 3417), CAGgucagcc (SEQ ID NO: 1278), CAGgcggugg (SEQ ID NO: 3418), CGAguaagcu (SEQ ID NO: 3419), CCCgugagca (SEQ ID NO: 3420), AAAguaauga (SEQ ID NO: 3421), CUGguaagcu (SEQ ID NO: 1702), CGGguaacca (SEQ ID NO: 3422), CAGgucgcac (SEQ ID NO: 3423), GAGguaggcc (SEQ ID NO: 3424), UAGgugagcc (SEQ ID NO: 2591), UAGguaggca (SEQ ID NO: 3425), GCGgugcgug (SEQ ID NO: 3426), AUGgugagua (SEQ ID NO: 961), GGGgugaggg (SEQ ID NO: 2282), GAGgucacac (SEQ ID NO: 3427), CAGguaggcc (SEQ ID NO: 3428), CAAgugcuga (SEQ ID NO: 3429), GUCgucuuca (SEQ ID NO: 3430), CAUguaagaa (SEQ ID NO: 1518), GUAguaagga (SEQ ID NO: 3431), UAGguuugua (SEQ ID NO: 2643), CAAguuagag (SEQ ID NO: 3432), AAGguagagu (SEQ ID NO: 208), AAGgugagau (SEQ ID NO: 338), AAAguaggua (SEQ ID NO: 37), ACAgugaauc (SEQ ID NO: 3433), CAGgugugcg (SEQ ID NO: 1436), CAGgucggcc (SEQ ID NO: 1299), AAGguaguau (SEQ ID NO: 3434), ACUgucaguc (SEQ ID NO: 3435), UCUgcagccu (SEQ ID NO: 3436), CGAguaagug (SEQ ID NO: 3437), AGAguaauua (SEQ ID NO: 3438), AGUgugagug (SEQ ID NO: 837), CCGgugagcg (SEQ ID NO: 3439), AAGguaaccu (SEQ ID NO: 3440), AAGguugugg (SEQ ID NO: 3441), AAGgcauggg (SEQ ID NO: 3442), AAGgucagag (SEQ ID NO: 284), ACGguaaggu (SEQ ID NO: 3443), GGGgugagca (SEQ ID NO: 3444), GAGguugcuu (SEQ ID NO: 3445), AAGguaucgc (SEQ ID NO: 3446), CCGguaaagg (SEQ ID NO: 3447), AAAguuaaug (SEQ ID NO: 3448), UAGguacgag (SEQ ID NO: 2510), ACCguaauua (SEQ ID NO: 3449), GGGguaagga (SEQ ID NO: 2249), CCGguaacgc (SEQ ID NO: 3450), CAGgucagaa (SEQ ID NO: 1275), AAGguacuga (SEQ ID NO: 197), GAGgugacca (SEQ ID NO: 2010), GGGgugagcc (SEQ ID NO: 2277), AAGguacagg (SEQ ID NO: 177), AUGguaauua (SEQ ID NO: 3451), CAGgugagag (SEQ ID NO: 1335), AAGgugacuc (SEQ ID NO: 3452), AUAguaagua (SEQ ID NO: 849), GAGguaaacc (SEQ ID NO: 1869), CAGgugggau (SEQ ID NO: 1405), CAGgugagaa (SEQ ID NO: 1333), AGGguaaaaa (SEQ ID NO: 3453), GAGgugugac (SEQ ID NO: 3454), CACguaagcu (SEQ ID NO: 3455), CAGguccccc (SEQ ID NO: 3456), CAGgucaggu (SEQ ID NO: 3457), CGGguaaguc (SEQ ID NO: 3458), ACGguauggg (SEQ ID NO: 3459), GAUguaaguu (SEQ ID NO: 2123), CAAguaauau (SEQ ID NO: 3460), CAGguugggg (SEQ ID NO: 3461), CCUgugcugg (SEQ ID NO: 3462), AAGguaugau (SEQ ID NO: 256), AGGguagagg (SEQ ID NO: 3463), AAGguggguu (SEQ ID NO: 386), CAGgugugaa (SEQ ID NO: 1430), UUGguaugug (SEQ ID NO: 2988), UUGguaucuc (SEQ ID NO: 2985), GGGgugagug (SEQ ID NO: 2284), CUGgugugug (SEQ ID NO: 1779), AGGguagggc (SEQ ID NO: 3464), GUGgugagua (SEQ ID NO: 3465), CAGguaugua (SEQ ID NO: 1258), AAGguacauu (SEQ ID NO: 181), UUAguaagug (SEQ ID NO: 2934), AAUguauauc (SEQ ID NO: 3466), CUUguaagua (SEQ ID NO: 1793), GAGguuagua (SEQ ID NO: 2087), CAGguaaggu (SEQ ID NO: 1146), CAGguaaugu (SEQ ID NO: 1155), AGGgugaggc (SEQ ID NO: 3467), CAGguauuuc (SEQ ID NO: 1269), CAGgucugga (SEQ ID NO: 1307), GGGgugugcu (SEQ ID NO: 3468), UAGgugagug (SEQ ID NO: 2598), AAUguaaccu (SEQ ID NO: 3469), UAAgugaguc (SEQ ID NO: 2439), CAGgugcacu (SEQ ID NO: 3470), ACGguaagua (SEQ ID NO: 579), GAGguauccu (SEQ ID NO: 3471), UCUguaaguc (SEQ ID NO: 2745), CAGguauuca (SEQ ID NO: 1263), UGUguaagug (SEQ ID NO: 3472), CCAgcaaggc (SEQ ID NO: 3473), GAGgugaagg (SEQ ID NO: 2006), AAUguggggu (SEQ ID NO: 3474), UCGgugcgug (SEQ ID NO: 3475), UUGguaaggc (SEQ ID NO: 3476), GAGguaagug (SEQ ID NO: 3477), AAAguaagau (SEQ ID NO: 14), UAGgucuuuu (SEQ ID NO: 3478), GAGgucugau (SEQ ID NO: 3479), CCAguuagag (SEQ ID NO: 3480), UGGgugaaaa (SEQ ID NO: 3481), AGAguaagau (SEQ ID NO: 662), CAGguaauug (SEQ ID NO: 1158), CAGgccgguc (SEQ ID NO: 3482), CCGguaagag (SEQ ID NO: 3483), GAGgugagcu (SEQ ID NO: 2021), CUGguaagac (SEQ ID NO: 3484), CAGgugagau (SEQ ID NO: 1336), CUGguuuguu (SEQ ID NO: 3485), UGGguaggua (SEQ ID NO: 3486), CAGguuagug (SEQ ID NO: 1457), CAGguguucg (SEQ ID NO: 3487), CGGguagguc (SEQ ID NO: 3488), GUGguacaua (SEQ ID NO: 3489), AAGguacuaa (SEQ ID NO: 194), GAUgugagua (SEQ ID NO: 3490), UGUguaagac (SEQ ID NO: 2904), GAGguagccg (SEQ ID NO: 3491), UAGgugaucu (SEQ ID NO: 3492), CAGguacgug (SEQ ID NO: 1185), CUUgucaguc (SEQ ID NO: 3493), GAGguaucac (SEQ ID NO: 3494), GAGguaauga (SEQ ID NO: 3495), AAGguaacac (SEQ ID NO: 3496), CAGguaaagc (SEQ ID NO: 1123), AAGgcaagua (SEQ ID NO: 3497), CGCgugagcc (SEQ ID NO: 3498), AGUgugcguu (SEQ ID NO: 3499), GAUguaagca (SEQ ID NO: 2118), AAGguaauag (SEQ ID NO: 159), GGAgcaguug (SEQ ID NO: 3500), AGCguaagau (SEQ ID NO: 3501), AAGgucaggc (SEQ ID NO: 290), GAGguauuca (SEQ ID NO: 3502), AAUguaaagu (SEQ ID NO: 3503), CAGguaacaa (SEQ ID NO: 3504), UCGguaggug (SEQ ID NO: 3505), AAAguaaguc (SEQ ID NO: 22), CGGgugcagu (SEQ ID NO: 3506), GGUgugugca (SEQ ID NO: 3507), UGAgugagaa (SEQ ID NO: 2794), CACguguaag (SEQ ID NO: 3508), GUGguuggua (SEQ ID NO: 3509), GCAgccuuga (SEQ ID NO: 3510), CGAgugugau (SEQ ID NO: 3511), CAGguauaua (SEQ ID NO: 3512), UAUguaugug (SEQ ID NO: 2665), CCCgugguca (SEQ ID NO: 3513), AUGguaagac (SEQ ID NO: 890), GAGgugugga (SEQ ID NO: 2074), AGUguauccu (SEQ ID NO: 3514), UGAgugugue (SEQ ID NO: 3515), UGGguaaucu (SEQ ID NO: 3516), AUGgcagguu (SEQ ID NO: 3517), GAGguaagau (SEQ ID NO: 1884), UCAgcagcgu (SEQ ID NO: 3518), AAGguggau (SEQ ID NO: 378), CGGgugcgcu (SEQ ID NO: 3519), CAGgugucug (SEQ ID NO: 1429), AGCgugguaa (SEQ ID NO: 3520), AAUgugaaug (SEQ ID NO: 3521), UCGgugagac (SEQ ID NO: 3522), UAGguaaagc (SEQ ID NO: 3523), CUGguaaaag (SEQ ID NO: 3524), CCGgugcgga (SEQ ID NO: 3525), CAGguacuca (SEQ ID NO: 3526), CAG-guagcaa (SEQ ID NO: 1203), GAAguugagu (SEQ ID NO: 3527), GAGguggagg (SEQ ID NO: 2052), AGGguaugag (SEQ ID NO: 762), UAGguaugcu (SEQ ID NO: 3528), UAGgugagac (SEQ ID NO: 2588), CAGguaauua (SEQ ID NO: 1156), CGUguaagcc (SEQ ID NO: 3529), CUU-guaaguu (SEQ ID NO: 1795), AAGguaacuu (SEQ ID NO: 140), UCGgcaaggc (SEQ ID NO: 3530), GAGguucucg (SEQ ID NO: 3531), GAGgugggcg (SEQ ID NO: 2058), AAGgcaugug (SEQ ID NO: 3532), CUGguauguu (SEQ ID NO: 1738), UAAgucauuu (SEQ ID NO: 3533), CAU-guaauua (SEQ ID NO: 1525), AAUguaaaga (SEQ ID NO: 3534), UAGgugcuca (SEQ ID NO: 3535), AAGguaaugg (SEQ ID NO: 166), GAGguacuga (SEQ ID NO: 3536), UGGguaagua (SEQ ID NO: 2841), UGGguaaaaa (SEQ ID NO: 3537), AAGgugagcu (SEQ ID NO: 342), UACgugaguu (SEQ ID NO: 3538), AGGgugagcc (SEQ ID NO: 790), CGGgugagga (SEQ ID NO: 3539), UGGgugagag (SEQ ID NO: 2869), GGUguaagcu (SEQ ID NO: 3540), CGGgugg-guu (SEQ ID NO: 1648), CCAgcuaagu (SEQ ID NO: 3541), AAGguuuguc (SEQ ID NO: 467), GAGguuagac (SEQ ID NO: 2084), GAGguaccuc (SEQ ID NO: 3542), UUU-guaaguu (SEQ ID NO: 3041), GAGguuagga (SEQ ID NO: 3543), CAGguaggga (SEQ ID NO: 1216), AGGguaauac (SEQ ID NO: 744), UGCgugugua (SEQ ID NO: 3544), CCAguaacca (SEQ ID NO: 3545), AGGgucuguc (SEQ ID NO: 3546), UGGguaugua (SEQ ID NO: 2860), GUG-guaagcu (SEQ ID NO: 2348), CAGguaaccu (SEQ ID NO: 3547), AAGgugaguu (SEQ ID NO: 350), UAGguucgug (SEQ ID NO: 3548), AAAguuagua (SEQ ID NO: 3549), UGGgcaaguc (SEQ ID NO: 2816), AAGgcacagu (SEQ ID NO: 3550), GUUguaaguc (SEQ ID NO: 2401), AAG-guuugcc (SEQ ID NO: 462), CUUgcauggg (SEQ ID NO: 3551), GCGgugagua (SEQ ID NO: 3552), GGGguaagcg (SEQ ID NO: 3553), GCCguaagaa (SEQ ID NO: 3554), GAGgucggga (SEQ ID NO: 3555), UUGguauugu (SEQ ID NO: 2990), AGUgugagac (SEQ ID NO: 3556), CUG-gugggga (SEQ ID NO: 1770), AGAguaaggu (SEQ ID NO: 668), CCGguggguc (SEQ ID NO: 3557), CAGguauucu (SEQ ID NO: 1264), UGGguaacgu (SEQ ID NO: 3558), UUGgugagag (SEQ ID NO: 3559), UAGguacccu (SEQ ID NO: 3560), GGGgugcguc (SEQ ID NO: 3561), AAGgcag-gag (SEQ ID NO: 3562), ACGguacauu (SEQ ID NO: 3563), GAGguaguua (SEQ ID NO: 1946), CAGguauggg (SEQ ID NO: 1256), UUUguguguc (SEQ ID NO: 3053), CAGguac-uua (SEQ ID NO: 1194), AUGguauacu (SEQ ID NO: 3564), AGUgugagcc (SEQ ID NO: 833), ACAguaacga (SEQ ID NO: 3565), CUGguaccca (SEQ ID NO: 3566), CAGguaaccc (SEQ ID NO: 3567), GGAguaagua (SEQ ID NO: 3568), GAGgugggug (SEQ ID NO: 2065), ACUguauguc (SEQ ID NO: 3569), ACGgugagua (SEQ ID NO: 606), CUGguaaugu (SEQ ID NO: 3570), AAGguaucag (SEQ ID NO: 247), CAGgugcccc (SEQ ID NO: 1370), AGUgucagug (SEQ ID NO: 3571), AAGguaggag (SEQ ID NO: 218), GGAguaugug (SEQ ID NO: 3572), UUGguauuuu (SEQ ID NO: 2992), CCUguuguga (SEQ ID NO: 3573), UUUguaagaa (SEQ ID NO: 3033), UAGguaacau (SEQ ID NO: 2475), CAG-guaagca (SEQ ID NO: 3574), CAGgucacag (SEQ ID NO: 3575), CAGgugugag (SEQ ID NO: 1432), UAGguuugcg (SEQ ID NO: 3576), CUGguaagaa (SEQ ID NO: 1697), ACGguuguau (SEQ ID NO: 3577), AAGguugggg (SEQ ID NO: 446), AAGgugaauu (SEQ ID NO: 329), GGGguuaguu (SEQ ID NO: 3578), ACGguaaggc (SEQ ID NO: 3579), CAGguuuaag (SEQ ID NO: 1496), CUGguaaguu (SEQ ID NO: 1709), GGGgugagag (SEQ ID NO: 3580), UGGgugg-guu (SEQ ID NO: 2886), GAGguuuguu (SEQ ID NO: 2111), UGGguaaaug (SEQ ID NO: 2826), CAGgcaggcc (SEQ ID NO: 3581), CACgugcagg (SEQ ID NO: 3582), AAGgugagcc (SEQ ID NO: 340), CAAguaagug (SEQ ID NO: 1028), CAGgucaguc (SEQ ID NO: 1282), GCG-guauaau (SEQ ID NO: 3583), UAGguaaagu (SEQ ID NO: 3584), UAGguggauu (SEQ ID NO: 3585), GAGgucugga (SEQ ID NO: 3586), UCGgucaguu (SEQ ID NO: 3587), UGGguaacug (SEQ ID NO: 3588), AAGguuugau (SEQ ID NO: 3589), UGUgcuggug (SEQ ID NO: 3590), UGUguac-cuc (SEQ ID NO: 3591), UGGguacagu (SEQ ID NO: 2849), AUCgucagcg (SEQ ID NO: 3592), CAGgucuugg (SEQ ID NO: 3593), GAAguuggua (SEQ ID NO: 3594), GAAguaaaga (SEQ ID NO: 3595), UUGguaagcu (SEQ ID NO: 2959), UAGguaccag (SEQ ID NO: 2507), AGGguau-cau (SEQ ID NO: 3596), CAGguaaaaa (SEQ ID NO: 1118), ACGguaauuu (SEQ ID NO: 583), AUUguaaguu (SEQ ID NO: 997), GAGguacagu (SEQ ID NO: 1908), CAGgugaaag (SEQ ID NO: 1315), UGGguuguuu (SEQ ID NO: 3597), GGGguaggug (SEQ ID NO: 2259), CAGgugccca (SEQ ID NO: 1369), AGCgugagau (SEQ ID NO: 3598), CCAgugagug (SEQ ID NO: 1565), AGGguagaug (SEQ ID NO: 3599), UGGguguguc (SEQ ID NO: 2888), AUCgcgugag (SEQ ID NO: 3600), AGGguaagcc (SEQ ID NO: 3601), AGGguagcag (SEQ ID NO: 3602), UUCguuuccg (SEQ ID NO: 3603), AAGguaagcg (SEQ ID NO: 147), UGGguaagcc (SEQ ID NO: 2837), CAGguauggc (SEQ ID NO: 3604), UGUguaagua (SEQ ID NO: 2907), AAGguagaga (SEQ ID NO: 3605), ACGguaauaa (SEQ ID NO: 3606), CUGguacggu (SEQ ID NO: 3607), GAGgu-cacag (SEQ ID NO: 3608), UAUguaaguu (SEQ ID NO: 2656), CUGguacgcc (SEQ ID NO: 3609), CAAguaagau (SEQ ID NO: 1024), CUAgugagua (SEQ ID NO: 1673), CCGguaaccg (SEQ ID NO: 3610), CUUguaaguc (SEQ ID NO: 3611), GUGgugagaa (SEQ ID NO: 2378), ACCguau-gua (SEQ ID NO: 3612), GUAguaagug (SEQ ID NO: 2324), UUGgugggua (SEQ ID NO: 3014), CGGguacuuu (SEQ ID NO: 3613), UGGguaaaua (SEQ ID NO: 2825), AGAgug-agua (SEQ ID NO: 704), AAGguagguu (SEQ ID NO: 230), AAGguaugcg (SEQ ID NO: 3614), CCUguaggcu (SEQ ID NO: 3615), ACAguagaaa (SEQ ID NO: 3616), CCGguu-agua (SEQ ID NO: 3617), CGGguaggcg (SEQ ID NO: 3618), GCAgugagug (SEQ ID NO: 2162), GAGgugaguc (SEQ ID NO: 3619), CUGguagccu (SEQ ID NO: 3620), CAUguaugua (SEQ ID NO: 1533), GAAguaacuu (SEQ ID NO: 3621), GAAguaagau (SEQ ID NO: 3622), AAGguua-gau (SEQ ID NO: 417), AAGguaauca (SEQ ID NO: 161), AAUguaugua (SEQ ID NO: 507), UGAguaagau (SEQ ID NO: 2767), AGAgugagca (SEQ ID NO: 703), GUAguucuau (SEQ ID NO: 3623), GAGguaauca (SEQ ID NO: 1898), UAGguaugga (SEQ ID NO: 2548), UAGgugggac (SEQ ID NO: 2612), GAGguacaug (SEQ ID NO: 3624), UGG-guaaggc (SEQ ID NO: 3625), CAGguacgcc (SEQ ID NO: 1182), CCAguuacgc (SEQ ID NO: 3626), ACUgugguga (SEQ ID NO: 3627), GAGguaaguc (SEQ ID NO: 1894), AUUguaggug (SEQ ID NO: 3628), ACCgucagug (SEQ ID NO: 3629), AAUgugaggg (SEQ ID NO: 3630), ACU-gugagug (SEQ ID NO: 645), UGGguguggu (SEQ ID NO: 3631), AAGguuggga (SEQ ID NO: 445), AAGguuugga (SEQ ID NO: 464), UCCgugagug (SEQ ID NO: 3632), CGGgugagug (SEQ ID NO: 1642), AGAguaagcu (SEQ ID NO: 664), CAGgcaagcu (SEQ ID NO: 3633), UAGguauauu (SEQ ID NO: 2541), AAAguagcag (SEQ ID NO: 3634), GAGguaaccu (SEQ ID NO: 1880), AAGgugggca (SEQ ID NO: 379), AGGgugagua (SEQ ID NO: 795), UGGguaaggu (SEQ ID NO: 2840), CUUgucagug (SEQ ID NO: 3635), UAGgugcgcu (SEQ ID NO: 3636), GAGgcaaauu (SEQ ID NO: 3637), AGGguaccuc (SEQ ID NO: 3638), CAAgugcgua (SEQ ID NO: 3639), AGAguaagac (SEQ ID NO: 660), GUGguaaaua (SEQ ID NO: 3640), GAUguaagcg (SEQ ID NO: 3641), GAGguaaagc (SEQ ID NO: 1871), UAGgugagua (SEQ ID NO: 2596), CAGguaacau (SEQ ID NO: 1130), CCUguacggc (SEQ ID NO: 3642), UAGguauguc (SEQ ID NO: 2552), UAGguccaua (SEQ ID NO: 3643), GAGgugaaaa (SEQ ID NO: 2003), AAAguacuga (SEQ ID NO: 3644), UUGguaagcg (SEQ ID NO: 3645), CAGgcaagcg (SEQ ID NO: 3646), UUUgcagguu (SEQ ID NO: 3647), CAGguuuaua (SEQ ID NO: 3648), CUGguaaagc (SEQ ID NO: 1686), AUGgugagcu (SEQ ID NO: 958), CAGgugguug (SEQ ID NO: 1419), GUAguaaguu (SEQ ID NO: 3649), CAGguaauac (SEQ ID NO: 3650), CAGgcaaggc (SEQ ID NO: 3651), AAGguaauuu (SEQ ID NO: 171), UUUguccgug (SEQ ID NO: 3652), GAGguagguu (SEQ ID NO: 1939), ACCgugagug (SEQ ID NO: 3653), CAAguaagcu (SEQ ID NO: 3654), ACAgugagua (SEQ ID NO: 560), UUGgugagau (SEQ ID NO: 3000), AAGguagucu (SEQ ID NO: 233), CAGguaaagg (SEQ ID NO: 3655), GGGguaugga (SEQ ID NO: 2264), UUUguaagug (SEQ ID NO: 3040), GUGguaagag (SEQ ID NO: 2344), AGUgugaguu (SEQ ID NO: 838), AAGgcaagcg (SEQ ID NO: 3656), UAAgugagua (SEQ ID NO: 2438), AGGgugagug (SEQ ID NO: 797), AGUguacgug (SEQ ID NO: 3657), AGGgugcgua (SEQ ID NO: 3658), GGCgugagcc (SEQ ID NO: 2238), CGAguuauga (SEQ ID NO: 3659), CAGguaaaga (SEQ ID NO: 1122), UUGgugaaga (SEQ ID NO: 3660), AGGguaaugg (SEQ ID NO: 3661), AAGguccaga (SEQ ID NO: 300), AGUgugaguc (SEQ ID NO: 836), CAGguaauuu (SEQ ID NO: 1159), CAGguaacgc (SEQ ID NO: 3662), CUGguacacu (SEQ ID NO: 3663), CUGguuagug (SEQ ID NO: 1782), CAGguacuug (SEQ ID NO: 3664), CACguaagua (SEQ ID NO: 3665), GUGgugcggc (SEQ ID NO: 3666), GAGgucaguu (SEQ ID NO: 3667), AUGguaugcc (SEQ ID NO: 932), AAGgugugug (SEQ ID NO: 405), CUGgugggucc (SEQ ID NO: 1772), CAGgugaggc (SEQ ID NO: 1342), AAGguuaguc (SEQ ID NO: 423), AAGguagcug (SEQ ID NO: 215), GAGgucagga (SEQ ID NO: 1983), GUUguaggua (SEQ ID NO: 3668), UGGguacaag (SEQ ID NO: 3669), AUGguaggug (SEQ ID NO: 924), GAGguaagcc (SEQ ID NO: 1886), AUGgcaagua (SEQ ID NO: 3670), AAGguauauu (SEQ ID NO: 245), GCGgugagag (SEQ ID NO: 3671), AAGgugcuuc (SEQ ID NO: 3672), UAGguacauc (SEQ ID NO: 3673), ACUgugguaa (SEQ ID NO: 3674), GAGguaggcu (SEQ ID NO: 1933), GAGguaugca (SEQ ID NO: 3675), AGGguaguuc (SEQ ID NO: 3676), CAGguauccu (SEQ ID NO: 1241), AGGguaaguc (SEQ ID NO: 741), AGGgucaguu (SEQ ID NO: 779), CAGguuggga (SEQ ID NO: 3677), CAGguggaua (SEQ ID NO: 3678), GGAguagguu (SEQ ID NO: 2220), GAGguaggau (SEQ ID NO: 3679), GGGguuugug (SEQ ID NO: 3680), UAGguaauug (SEQ ID NO: 3681), AAGguaaccc (SEQ ID NO: 136), ACGguaagaa (SEQ ID NO: 3682), GAGguagggg (SEQ ID NO: 1936), CGAguaggug (SEQ ID NO: 1619), UCCguaagug (SEQ ID NO: 2710), UCGguacagg (SEQ ID NO: 3683), CAAguaagcg (SEQ ID NO: 3684), AAGguccgcg (SEQ ID NO: 3685), AAUgugagua (SEQ ID NO: 523), CAGgugaaug (SEQ ID NO: 3686), GUGguaaggc (SEQ ID NO: 2350), AGAgugagug (SEQ ID NO: 706), UCUguauguc (SEQ ID NO: 3687), UGGgugaguc (SEQ ID NO: 2876), UCGguuagua (SEQ ID NO: 3688), GAUguaugca (SEQ ID NO: 3689), GAGguuggug (SEQ ID NO: 3690), GAGguggggc (SEQ ID NO: 2061), UGGgucaguc (SEQ ID NO: 3691), GCAgugagua (SEQ ID NO: 2161), CAGguugcuu (SEQ ID NO: 3692), AGGguagagu (SEQ ID NO: 3693), UAGgucaggu (SEQ ID NO: 2567), CGCguaugua (SEQ ID NO: 3694), GAGguauuaa (SEQ ID NO: 3695), CAGguaaacu (SEQ ID NO: 3696), AAAguaaguu (SEQ ID NO: 24), GGGgucuggc (SEQ ID NO: 3697), GCUguggggu (SEQ ID NO: 3698), UUGguaaguc (SEQ ID NO: 3699), AAGguagaag (SEQ ID NO: 3700), AAUgugaguc (SEQ ID NO: 524), AAGgucagcu (SEQ ID NO: 288), AAGguaagag (SEQ ID NO: 143), AUGgugagga (SEQ ID NO: 3701), AAGguacuuc (SEQ ID NO: 200), AAGguaagaa (SEQ ID NO: 141), CCGguacagc (SEQ ID NO: 3702), GCGgugcgga (SEQ ID NO: 3703), CAGguacaua (SEQ ID NO: 1168), CUGgugagga (SEQ ID NO: 1755), CUGguaggug (SEQ ID NO: 1731), AACguagguu (SEQ ID NO: 3704), AUGgugugug (SEQ ID NO: 975), UUGguacuau (SEQ ID NO: 3705), CAGgucggug (SEQ ID NO: 1300), CAGgcauggg (SEQ ID NO: 3706), AUGguaucuu (SEQ ID NO: 929), AAGguaacua (SEQ ID NO: 137), CAGgugggcg (SEQ ID NO: 3707), CACgugagga (SEQ ID NO: 3708), AAGgugguuc (SEQ ID NO: 392), UGGgcauucu (SEQ ID NO: 3709), AUGguaagcc (SEQ ID NO: 894), AGGgucagug (SEQ ID NO: 778), AGAguacgua (SEQ ID NO: 3710), AAGguaggca (SEQ ID NO: 220), AAGguauuca (SEQ ID NO: 3711), CAGguagauu (SEQ ID NO: 1202), GAGguauuua (SEQ ID NO: 1972), GAGgucuaca (SEQ ID NO: 3712), GUUguagguc (SEQ ID NO: 3713), CAGguacucg (SEQ ID NO: 3714), GUCguauguu (SEQ ID NO: 3715), AAGguacuuu (SEQ ID NO: 202), AGAgugagau (SEQ ID NO: 702), AGUguuggua (SEQ ID NO: 3716), AAUgugagug (SEQ ID NO: 525), AAGguagauu (SEQ ID NO: 3717), AUGguuugua (SEQ ID NO: 988), GAGgccccag (SEQ ID NO: 3718), AUGgucaguu (SEQ ID NO: 3719), UCUguaagga (SEQ ID NO: 3720), CAGgucgggc (SEQ ID NO: 3721), CAGguaagcc (SEQ ID NO: 1142), UAGgucagug (SEQ ID NO: 2569), AGAguaggaa (SEQ ID NO: 683), CUGguacuuc (SEQ ID NO: 3722), CUCguaagca (SEQ ID NO: 1674), CAGguaacua (SEQ ID NO: 1134), CAGguggcug (SEQ ID NO: 1401), UGGguccgua (SEQ ID NO: 3723), GAGguugugc (SEQ ID NO: 3724), CAGgugcgcg (SEQ ID NO: 1377), AAAguauggc (SEQ ID NO: 3725), UGAguacgua (SEQ ID NO: 2779), CUGguacgga (SEQ ID NO: 3726), CAAgugaccu (SEQ ID NO: 3727), AAGgugaugu (SEQ ID NO: 356), AAGgucugca (SEQ ID NO: 3728), AAAguuugua (SEQ ID NO: 75), AAGgugagca (SEQ ID NO: 339), GAUguaagcc (SEQ ID NO: 2119), CAAguaauuu (SEQ ID NO: 1035), CAGgugugug (SEQ ID NO: 1442), UGGgugaggg (SEQ ID NO: 2874), AAGgugaccu (SEQ ID NO: 3729), UAGgugugag (SEQ ID NO: 2621), CAGgcagguc (SEQ ID NO: 3730), UCAguaaguu (SEQ ID NO: 2692), UCAgcaguga (SEQ ID NO: 3731), AAGguaccac (SEQ ID NO: 3732), UAAguaggug (SEQ ID NO: 3733), AAGgucagcc (SEQ ID NO: 286), CAGguaacuc (SEQ ID NO: 1135), AAAguaagag (SEQ ID NO: 13), AAGguagaua (SEQ ID NO: 209), AAGgcaaggg (SEQ ID NO: 99), CAGgugucgg (SEQ ID NO: 3734), CAGguggcua (SEQ ID NO: 3735), GAGguugcca (SEQ ID NO: 3736), CAGgccgugg (SEQ ID NO: 3737), UUGguauaug (SEQ ID NO: 3738), GAGguugagu (SEQ ID NO: 3739), GAGguagguc (SEQ ID NO: 3740), GUGguaagac (SEQ ID NO: 2343), UAGguccuuc (SEQ ID NO: 3741), GAGgcaaguc (SEQ ID NO: 3742), GAGguaacau (SEQ ID NO: 3743), CAGguauauc (SEQ ID NO: 1236), UCGguugguu (SEQ ID NO: 3744), CAGgugaacc (SEQ ID NO: 3745), CAGgucuuuu (SEQ ID NO: 3746), CAGgcauggc (SEQ ID NO: 3747), AAAguacuug (SEQ ID NO: 32), CAGgugauuc (SEQ ID NO: 1356), UUGguagguu (SEQ ID NO: 3748), UAUgugagca (SEQ ID NO: 3749), CAGgugagcg (SEQ ID NO: 1339), AAUguaauaa (SEQ ID NO: 3750), AAAguaaggc (SEQ ID NO: 3751), UAGguuuguc (SEQ ID NO: 2644), UAGgugggag (SEQ ID NO: 2613), GAGguaaguu (SEQ ID NO: 3752), AAGguagccg (SEQ ID NO:

3753), CAGguggugc (SEQ ID NO: 3754), UGAgucaguu (SEQ ID NO: 3755), CUGguaggcc (SEQ ID NO: 3756), CAAguaagga (SEQ ID NO: 3757), CGGguaaggc (SEQ ID NO: 3758), AAGgcgagga (SEQ ID NO: 3759), CAG-guaguuc (SEQ ID NO: 1230), CAGguaagga (SEQ ID NO: 1143), CCUgugagug (SEQ ID NO: 1610), AAGguaaaug (SEQ ID NO: 132), CCGguaauua (SEQ ID NO: 3760), CAGguaaguu (SEQ ID NO: 1149), AAGgugguca (SEQ ID NO: 3761), CAGguaccuc (SEQ ID NO: 1177), AUCgua-agua (SEQ ID NO: 3762), CCGguacaua (SEQ ID NO: 3763), GCGgugagug (SEQ ID NO: 3764), GAGgugguau (SEQ ID NO: 2067), CUGgugugga (SEQ ID NO: 3765), GAGguaauuc (SEQ ID NO: 3766), CAAguacgua (SEQ ID NO: 3767), UCUguaagug (SEQ ID NO: 2746), AAU-guaagug (SEQ ID NO: 491), AGGgucuguu (SEQ ID NO: 783), GAGguacugc (SEQ ID NO: 1918), AGGguaaggc (SEQ ID NO: 738), AAGgcaagag (SEQ ID NO: 95), CAG-guggguu (SEQ ID NO: 1416), UAGguuagga (SEQ ID NO: 3768), UGAguaagcu (SEQ ID NO: 2769), AGAguaagag (SEQ ID NO: 661), AUGgcaggug (SEQ ID NO: 3769), UAGgcaagua (SEQ ID NO: 3770), AUGguaggua (SEQ ID NO: 923), GCAgcccgca (SEQ ID NO: 3771), ACGguaaacu (SEQ ID NO: 3772), AGGgugaguu (SEQ ID NO: 798), GUAguagucu (SEQ ID NO: 3773), GUGgcugaaa (SEQ ID NO: 3774), CAGguuaguc (SEQ ID NO: 1456), CUG-gugagca (SEQ ID NO: 1753), UCAguaagug (SEQ ID NO: 2691), AAAgugauug (SEQ ID NO: 3775), UAGgucugga (SEQ ID NO: 3776), GAGguguuuc (SEQ ID NO: 3777), AAGguaaauu (SEQ ID NO: 133), CAUguacauc (SEQ ID NO: 3778), AAGguuugaa (SEQ ID NO: 3779), CCAgcaagug (SEQ ID NO: 3780), UAGguaauaa (SEQ ID NO: 3781), GAGgcaagug (SEQ ID NO: 1859), CAAgugauuc (SEQ ID NO: 1071), CAGgucgugg (SEQ ID NO: 3782), GAAguaugcc (SEQ ID NO: 3783), UCG-gugcccu (SEQ ID NO: 3784), GAGgucaguc (SEQ ID NO: 3785), CAGgugagac (SEQ ID NO: 1334), UUUgucugua (SEQ ID NO: 3786), CAGguagaua (SEQ ID NO: 3787), UGGguaucag (SEQ ID NO: 3788), UAGgugggcu (SEQ ID NO: 2616), AUGgugagau (SEQ ID NO: 3789), CAG-guaacac (SEQ ID NO: 3790), CCGguauccu (SEQ ID NO: 3791), UAGguaagcu (SEQ ID NO: 2487), UCAguacauc (SEQ ID NO: 3792), UAGguuugcc (SEQ ID NO: 2642), AUGguaagaa (SEQ ID NO: 889), UUGguaagac (SEQ ID NO: 3793), CCGguuaguc (SEQ ID NO: 3794), GAG-guaagaa (SEQ ID NO: 1882), UGGguaaguu (SEQ ID NO: 2844), CCGgugagaa (SEQ ID NO: 1585), CCUgugaggg (SEQ ID NO: 1608), ACGguaggag (SEQ ID NO: 590), ACAguauguc (SEQ ID NO: 3795), CAGguauuaa (SEQ ID NO: 3796), CAGguggauc (SEQ ID NO: 3797), AGAgugcgua (SEQ ID NO: 3798), AAGgugaccg (SEQ ID NO: 3799), AGAguaggug (SEQ ID NO: 687), ACUguaugua (SEQ ID NO: 3800), UAGgucaauu (SEQ ID NO: 3801), AGUguguaag (SEQ ID NO: 3802), CGGguaccuu (SEQ ID NO: 3803), CUAgugaguu (SEQ ID NO: 3804), CUAguaagug (SEQ ID NO: 1666), CAGguacaac (SEQ ID NO: 3805), UAGgugugug (SEQ ID NO: 2627), CAU-guacggc (SEQ ID NO: 3806), AUGgugugag (SEQ ID NO: 3807), AGGguggaag (SEQ ID NO: 3808), CAGgugcgag (SEQ ID NO: 3809), UAGgugcucc (SEQ ID NO: 3810), AAGguguggg (SEQ ID NO: 390), AAGgucuguu (SEQ ID NO: 317), CAGgugggcc (SEQ ID NO: 1407), AAGgucaguc (SEQ ID NO: 294), CAGguuuuua (SEQ ID NO: 3811), AACgugaggu (SEQ ID NO: 3812), CGGguaagag (SEQ ID NO: 3813), UUUgucggua (SEQ ID NO: 3814), UAG-guuaagu (SEQ ID NO: 3815), GUGguaagaa (SEQ ID NO: 2342), CAGguauugg (SEQ ID NO: 1266), GCUguaaguu (SEQ ID NO: 2196), CUAguaagua (SEQ ID NO: 1664), UCGguaaaua (SEQ ID NO: 3816), CAGguaacuu (SEQ ID NO: 1137), CCUgugagua (SEQ ID NO: 3817), CAG-guuauau (SEQ ID NO: 3818), CUGgugaaca (SEQ ID NO: 3819), AAGguauaaa (SEQ ID NO: 238), GAGguaagca (SEQ ID NO: 1885), AAGgugaagc (SEQ ID NO: 324), CAGgugaguu (SEQ ID NO: 1348), UUUgugagua (SEQ ID NO: 3820), CUUguacgcc (SEQ ID NO: 3821), AGAguaagug (SEQ ID NO: 670), UGGguaggug (SEQ ID NO: 2853), UGAgcccugc (SEQ ID NO: 3822), UGUguau-gua (SEQ ID NO: 3823), AAGguagagg (SEQ ID NO: 3824), GAGgugggggg (SEQ ID NO: 2062), UAGguaauuc (SEQ ID NO: 2502), AAGgcauggu (SEQ ID NO: 3825), AGAguaagca (SEQ ID NO: 663), AAGguaggaa (SEQ ID NO: 217), CAAguaagua (SEQ ID NO: 1026), ACUguaauug (SEQ ID NO: 3826), CAGgucugug (SEQ ID NO: 1311), UCGguaccga (SEQ ID NO: 3827), CUGgugagag (SEQ ID NO: 3828), AAGguuugcu (SEQ ID NO: 463), AUGguaccac (SEQ ID NO: 3829), UAAguuaguu (SEQ ID NO: 3830), CAGguaggac (SEQ ID NO: 1213), AGAgugaggc (SEQ ID NO: 3831), CGAgucagua (SEQ ID NO: 3832), CAGgu-cugag (SEQ ID NO: 1304), GAGguggugg (SEQ ID NO: 3833), ACGguauugg (SEQ ID NO: 3834), GCUgcgagua (SEQ ID NO: 3835), CUGguaagug (SEQ ID NO: 1708), GUGgugagau (SEQ ID NO: 2379), GGGguuugau (SEQ ID NO: 3836), UCUgugagug (SEQ ID NO: 2762), CUUguc-agua (SEQ ID NO: 1801), GAGguaaaac (SEQ ID NO: 1866), UCUguaagau (SEQ ID NO: 2741), CCAguaaguu (SEQ ID NO: 1558), CAGguaaagu (SEQ ID NO: 1124), GCGgugagca (SEQ ID NO: 2179), UAAguaagag (SEQ ID NO: 2416), CUGgcaggug (SEQ ID NO: 3837), GAG-guaaggg (SEQ ID NO: 1891), UGAguaaguu (SEQ ID NO: 2775), GAGgugagac (SEQ ID NO: 2015), GCUgucuguu (SEQ ID NO: 3838), AAGguaacaa (SEQ ID NO: 134), GAGguaacgg (SEQ ID NO: 3839), CUGguauucu (SEQ ID NO: 3840), CAAguaacug (SEQ ID NO: 1021), AAG-gugggggu (SEQ ID NO: 383), UAGguauggc (SEQ ID NO: 2549), CAGguauuuu (SEQ ID NO: 1271), GUGguaaacu (SEQ ID NO: 3841), GAGgucugag (SEQ ID NO: 1998), CUGguaaggu (SEQ ID NO: 1706), CAAguaaguu (SEQ ID NO: 1029), AAGguagacc (SEQ ID NO: 206), GAGgcgagcg (SEQ ID NO: 3842), CUGguaaaua (SEQ ID NO: 1687), UGUguaagcg (SEQ ID NO: 3843), CAGguuaggg (SEQ ID NO: 1453), GGGgugagga (SEQ ID NO: 2280), ACAguau-gug (SEQ ID NO: 3844), CCGgugggga (SEQ ID NO: 3845), GAGgucagug (SEQ ID NO: 3846), AGGguaaggu (SEQ ID NO: 3847), ACAguaagua (SEQ ID NO: 546), GGUguaaggu (SEQ ID NO: 3848), GAGguaauaa (SEQ ID NO: 1895), CAGguauucc (SEQ ID NO: 3849), CUGguauaaa (SEQ ID NO: 3850), CCGgucugug (SEQ ID NO: 3851), CAG-guaacug (SEQ ID NO: 1136), GCAguaagua (SEQ ID NO: 2147), AAGguagggg (SEQ ID NO: 225), CAAguccacc (SEQ ID NO: 3852), CAAguuggug (SEQ ID NO: 3853), CAGgugcggu (SEQ ID NO: 1379), CAGguaaaau (SEQ ID NO: 3854), ACGguaagga (SEQ ID NO: 3855), UGG-guaauaa (SEQ ID NO: 3856), UAGguaagug (SEQ ID NO: 2493), CCGguagguu (SEQ ID NO: 3857), AGAguaugga (SEQ ID NO: 3858), CUCgugaguc (SEQ ID NO: 3859), AAAgccggug (SEQ ID NO: 3860), UUGguaauuu (SEQ ID NO: 2970), GAGguaaaag (SEQ ID NO: 1867), CCUgu-gugag (SEQ ID NO: 3861), AAAguaagga (SEQ ID NO: 18), UGAgugagug (SEQ ID NO: 2800), AAGguacaug (SEQ ID NO: 180), CCGguaaaug (SEQ ID NO: 3862), CAGgugaagc (SEQ ID NO: 3863), CAGguacccg (SEQ ID NO: 1173), GAGguaaggc (SEQ ID NO: 1890), UUUguauguu (SEQ ID NO: 3049), CAGgugcucc (SEQ ID NO: 1386), UCGguag-guc (SEQ ID NO: 3864), CGGgugaggc (SEQ ID NO: 3865), AAGguaauua (SEQ ID NO: 168), ACUgugaguc (SEQ ID NO: 644), AAGgucagca (SEQ ID NO: 285), GUGgugagug (SEQ ID NO: 2384), CAUguccacc (SEQ ID NO: 3866), AAGgugaccc (SEQ ID NO: 3867), CGGguuagua (SEQ ID NO: 3868), GCGguaguaa (SEQ ID NO: 3869), GCUguaggua (SEQ ID NO: 3870), CCUguugagu (SEQ ID NO: 3871), UAGgucuggc (SEQ ID NO: 2577), GAUgugagcc (SEQ ID NO: 2131), CUUgugagua (SEQ ID NO: 1802), CUGguguguu (SEQ ID NO: 1780), GAGgcaugug (SEQ ID NO: 1863), CAGgcaagag (SEQ ID NO: 1101), UUGguaagaa (SEQ ID NO: 2957), GAGguguggg (SEQ ID NO: 2075), GAGguauuuu (SEQ ID NO: 1975), CAGguaguaa (SEQ ID NO: 1224), AGGguaagac (SEQ ID NO: 3872), UUUguaggca (SEQ ID NO: 3873), AGGgugagau (SEQ ID NO: 3874), GAGguuugua (SEQ ID NO: 2110), AAGgugagug (SEQ ID NO: 349), GAGgugggag (SEQ ID NO: 2055), AAGgugagaa (SEQ ID NO: 335), CUGguaagag (SEQ ID NO: 1698), AUAguaaaga (SEQ ID NO: 3875), GAUgugaguc (SEQ ID NO: 2134), AAGgugcagg (SEQ ID NO: 3876), CAGgucuguc (SEQ ID NO: 1310), GAGgugauuu (SEQ ID NO: 3877), CAGguuggcu (SEQ ID NO: 3878), CGGguauggg (SEQ ID NO: 3879), AUGguccauc (SEQ ID NO: 3880), CCGguuggug (SEQ ID NO: 3881), GGAguaaguc (SEQ ID NO: 3882), AAUguaagga (SEQ ID NO: 488), CAGguuuguu (SEQ ID NO: 1510), UAGgugugua (SEQ ID NO: 2626), UAUgucuuug (SEQ ID NO: 3883), ACGguacuuc (SEQ ID NO: 3884), AAGgcacgcg (SEQ ID NO: 3885), CUGguaaacc (SEQ ID NO: 1684), CUUgugggua (SEQ ID NO: 3886), UGAguaaguc (SEQ ID NO: 2773), CUGguggggug (SEQ ID NO: 1773), GAGguggaga (SEQ ID NO: 3887), GUGguggcug (SEQ ID NO: 3888), GUGguaagug (SEQ ID NO: 2353), AACgugagua (SEQ ID NO: 3889), GAAgcuguaa (SEQ ID NO: 3890), CGGguaucuu (SEQ ID NO: 3891), CAGgugucag (SEQ ID NO: 1424), AAUguacgca (SEQ ID NO: 3892), CCGgugggua (SEQ ID NO: 3893), UGGgugaggu (SEQ ID NO: 3894), AAGguauguu (SEQ ID NO: 266), CAGguauguu (SEQ ID NO: 1261), CAGguuugcu (SEQ ID NO: 1505), UUGguaaguu (SEQ ID NO: 2964), CAGguaguug (SEQ ID NO: 1231), CCUgugaaua (SEQ ID NO: 3895), GCUgugugug (SEQ ID NO: 3896), CAAguaauuc (SEQ ID NO: 1033), AGGguaaugu (SEQ ID NO: 3897), GCUgugaguc (SEQ ID NO: 2205), ACCguaaguu (SEQ ID NO: 3898), CGUguaagua (SEQ ID NO: 3899), GGGguaaguc (SEQ ID NO: 3900), AAUguaugau (SEQ ID NO: 3901), AAUgugauua (SEQ ID NO: 3902), UCAguaagaa (SEQ ID NO: 2682), CAGguccguc (SEQ ID NO: 3903), GAAguauuga (SEQ ID NO: 3904), UUGguaagga (SEQ ID NO: 2960), CAGgucgguu (SEQ ID NO: 3905), UAGguuagug (SEQ ID NO: 2635), ACGguaaaac (SEQ ID NO: 577), AAGguagguc (SEQ ID NO: 228), UACgugagua (SEQ ID NO: 3906), UUGguaagca (SEQ ID NO: 3907), GCGgugaguc (SEQ ID NO: 3908), GAAguaaggg (SEQ ID NO: 3909), CGCgugaguu (SEQ ID NO: 3910), CAGguacccc (SEQ ID NO: 3911), UCUguaagac (SEQ ID NO: 3912), GAGgugggca (SEQ ID NO: 2057), AAUguaagac (SEQ ID NO: 3913), CAGgcaaggg (SEQ ID NO: 3914), CAAguaacua (SEQ ID NO: 1020), AAAguuuguc (SEQ ID NO: 3915), CAGguacugu (SEQ ID NO: 1193), AAGgucccuc (SEQ ID NO: 303), UCGguaaguc (SEQ ID NO: 3916), UGGgugagug (SEQ ID NO: 2877), CUUgugagau (SEQ ID NO: 3917), AGAgugagcu (SEQ ID NO: 3918), UAAgugggga (SEQ ID NO: 3919), UAGguaggga (SEQ ID NO: 2522), CAGguuagcc (SEQ ID NO: 1452), AGGguaauca (SEQ ID NO: 3920), AAGguucagc (SEQ ID NO: 3921), UGGgugggug (SEQ ID NO: 2885), CAGguuguga (SEQ ID NO: 1494), AAGguaagug (SEQ ID NO: 155), CAUgugcgua (SEQ ID NO: 1543), CCGguauauu (SEQ ID NO: 3922), ACCguaugug (SEQ ID NO: 3923), CAGguauagu (SEQ ID NO: 3924), CAGguauuac (SEQ ID NO: 3925), CAGgugcagg (SEQ ID NO: 1364), GUGgugagcu (SEQ ID NO: 2381), AAGguaacau (SEQ ID NO: 135), CUGgugaugg (SEQ ID NO: 3926), AUGguaaaug (SEQ ID NO: 882), CCGgugagca (SEQ ID NO: 3927), AAGguaaacc (SEQ ID NO: 124), AAGguacugg (SEQ ID NO: 3928), GCGgucagga (SEQ ID NO: 3929), CUGgucaggg (SEQ ID NO: 3930), AAAguacguu (SEQ ID NO: 3931), AGAguagguu (SEQ ID NO: 688), AGGguaagcu (SEQ ID NO: 3932), AUUgugagua (SEQ ID NO: 1009), CCGgccacca (SEQ ID NO: 3933), GAGguaacuu (SEQ ID NO: 1881), GAGguaugaa (SEQ ID NO: 1956), CAGgucagac (SEQ ID NO: 1276), UAGgcgugug (SEQ ID NO: 2462), AGGguaaguu (SEQ ID NO: 743), CAGgcaugag (SEQ ID NO: 1111), CAGguaacgu (SEQ ID NO: 1133), CAGgcgagca (SEQ ID NO: 3934), UAGguauggu (SEQ ID NO: 2550), AGAguaggau (SEQ ID NO: 3935), CUGguuucaa (SEQ ID NO: 3936), GAGguaaacu (SEQ ID NO: 3937), CAGgcaugca (SEQ ID NO: 1112), UUGguaaucu (SEQ ID NO: 3938), AGGgcagaau (SEQ ID NO: 3939), AUGguaaaac (SEQ ID NO: 877), GCUgcaggug (SEQ ID NO: 3940), GAAgcacgug (SEQ ID NO: 3941), CAUguaaaca (SEQ ID NO: 3942), UGGguaagau (SEQ ID NO: 2835), AGGguagcua (SEQ ID NO: 3943), AGGgugggu (SEQ ID NO: 800), CCUguaaguu (SEQ ID NO: 1600), UGAgugaguu (SEQ ID NO: 2801), GGAguaugua (SEQ ID NO: 3944), CAGgugaccu (SEQ ID NO: 1328), AAAguacgga (SEQ ID NO: 3945), GAGguacaga (SEQ ID NO: 1906), GAUguaggua (SEQ ID NO: 2125), GGGguaauug (SEQ ID NO: 3946), UAGgugggguu (SEQ ID NO: 2617), GUGguacgua (SEQ ID NO: 3947), AAGguacagc (SEQ ID NO: 3948), GAGgugaaga (SEQ ID NO: 3949), GGGguaagca (SEQ ID NO: 2246), UGAguagguc (SEQ ID NO: 3950), GGGguaaguu (SEQ ID NO: 2253), AUUgugaguu (SEQ ID NO: 1011), UCAguaagac (SEQ ID NO: 3951), AGUgugagcu (SEQ ID NO: 834), AAGgcaaaac (SEQ ID NO: 3952), CUGgugaguc (SEQ ID NO: 1760), AAGgucucug (SEQ ID NO: 310), GAGgcugugc (SEQ ID NO: 3953), AGAgugagac (SEQ ID NO: 700), GAGgugaugu (SEQ ID NO: 2033), AGAguauggu (SEQ ID NO: 3954), UGGgugggguc (SEQ ID NO: 2884), GCUgcugagc (SEQ ID NO: 3955), CAGguagcug (SEQ ID NO: 1210), UAGgucagaa (SEQ ID NO: 3956), CCGguaggug (SEQ ID NO: 3957), GCAguaugau (SEQ ID NO: 3958), CAGguuucag (SEQ ID NO: 3959), GAGguuugcc (SEQ ID NO: 3960), GGGgugggggg (SEQ ID NO: 3961), AAGguacaua (SEQ ID NO: 179), UGGguguguu (SEQ ID NO: 2890), AGAguaaggc (SEQ ID NO: 666), GCGguuagug (SEQ ID NO: 3962), AAGgugacuu (SEQ ID NO: 334), AUGguaagau (SEQ ID NO: 892), AUGguaguug (SEQ ID NO: 3963), CAUguaagac (SEQ ID NO: 3964), CUGguaugua (SEQ ID NO: 1736), UUCguaagga (SEQ ID NO: 3965), GAAguaugac (SEQ ID NO: 3966), CGGguaauuc (SEQ ID NO: 1627), UGGguaacuu (SEQ ID NO: 2831), CAGgugccua (SEQ ID NO: 1372), CAUguagggc (SEQ ID NO: 3967), ACCgucagga (SEQ ID NO: 3968), CGUguucgau (SEQ ID NO: 3969), GAGgcaggac (SEQ ID NO: 3970), UAGguaauau (SEQ ID NO: 2496), UCGguauacu (SEQ ID NO: 3971), UAGguugugc (SEQ ID NO: 3972), CCGgugaguc (SEQ ID NO: 3973), CAGgugccaa (SEQ ID NO: 1368), CAGgugaugc (SEQ ID NO: 1352), AAGgugagga (SEQ ID NO: 343), GUGgugaggg (SEQ ID NO: 3974), UGGgucagua (SEQ ID NO: 3975), GAGgucaggg (SEQ ID NO: 1985), UAGguacgua (SEQ ID NO: 2511), GAGgcaagag (SEQ ID NO: 1857), CCUguuggua (SEQ ID NO: 3976), GAGguaucca (SEQ ID NO: 3977), UAAguaagcu (SEQ ID NO: 2419), AAGgucaguu (SEQ ID NO: 296), AAAguuaaag (SEQ ID NO: 3978), GAGgugcuau (SEQ ID NO: 3979), ACGguaagu (SEQ ID NO: 581), CUGgugaggg (SEQ ID NO: 1757), GAGguuaugu (SEQ ID NO: 2091), CUUgugugca (SEQ ID NO: 3980), UGAgcugggg (SEQ ID NO: 3981), AAGguauagu (SEQ ID NO: 3982), UAGguaaaac (SEQ ID NO: 2464), GGGgugaggu (SEQ ID NO: 3983), GAGgcaagca (SEQ ID NO: 3984), GGAguaacgu (SEQ ID NO: 3985), AGAguaagua (SEQ ID NO: 3986), AAAguaagua (SEQ ID NO: 21), GAGgcaacca (SEQ ID NO: 3987), UGUguaaguu (SEQ ID NO: 2909), UAGgugaggc (SEQ ID NO: 2594), ACAguaagaa (SEQ ID NO: 544), UGAguaagug (SEQ ID NO: 2774), CAAgucagua (SEQ ID NO: 1057), AGGguaaaug (SEQ ID NO: 3988), AAGguaugca (SEQ ID NO: 257), GCUgugcgug (SEQ ID NO: 3989), GAGguucgcc (SEQ ID NO: 3990), AAGgcuugca (SEQ ID NO: 3991), CAGgcaagug (SEQ ID NO: 1104), AUAguaaguc (SEQ ID NO: 3992), UUGguaggua (SEQ ID NO: 2978), GCAgcaggua (SEQ ID NO: 3993), AAGguauauc (SEQ ID NO: 243), AGCguaagcc (SEQ ID NO: 3994), CUGguucgaa (SEQ ID NO: 3995), ACGgugggug (SEQ ID NO: 612), CUGgucauug (SEQ ID NO: 3996), CAGgucagga (SEQ ID NO: 1280), CAAgugagac (SEQ ID NO: 1062), GAGguacugg (SEQ ID NO: 1919), GAGguguagu (SEQ ID NO: 3997), GAGguguccu (SEQ ID NO: 3998), CAGgugcgua (SEQ ID NO: 1380), AGUgcccuga (SEQ ID NO: 3999), AUGgugaguc (SEQ ID NO: 962), UGUgugugua (SEQ ID NO: 4000), CAGguaugcu (SEQ ID NO: 1254), CUGguacagu (SEQ ID NO: 4001), UUGguacgua (SEQ ID NO: 4002), UCUguacgua (SEQ ID NO: 4003), UAAguaauuc (SEQ ID NO: 4004), CACguaugug (SEQ ID NO: 4005), CAGgcaagua (SEQ ID NO: 1103), UCGgugagug (SEQ ID NO: 4006), GGUgugaguc (SEQ ID NO: 2315), UCUguaagcu (SEQ ID NO: 2743), AAGguucaga (SEQ ID NO: 4007), AGGguacuuc (SEQ ID NO: 4008), GCGgcagguu (SEQ ID NO: 4009), GAGgcccgug (SEQ ID NO: 4010), CAGguauaaa (SEQ ID NO: 4011), AUGgucaagu (SEQ ID NO: 4012), AAGgugagua (SEQ ID NO: 347), GUGguuuguu (SEQ ID NO: 4013), AGAgugagga (SEQ ID NO: 4014), GAGguaugac (SEQ ID NO: 1957), UAGgcgugag (SEQ ID NO: 4015), AAGguacucc (SEQ ID NO: 4016), UGAgugagga (SEQ ID NO: 2798), GAGguaugau (SEQ ID NO: 4017), GGGgucggua (SEQ ID NO: 4018), ACGguaugca (SEQ ID NO: 4019), CAGguaccac (SEQ ID NO: 1171), UAAguaccug (SEQ ID NO: 4020), AGGgugggcu (SEQ ID NO: 4021), CUGgucuguu (SEQ ID NO: 4022), UAGgucagag (SEQ ID NO: 4023), AAGguguguu (SEQ ID NO: 406), CUGgucagug (SEQ ID NO: 4024), AAGgugggac (SEQ ID NO: 4025), GUGguaguag (SEQ ID NO: 4026), CUAguuuagg (SEQ ID NO: 4027), CCCgccccau (SEQ ID NO: 4028), GCUguacugc (SEQ ID NO: 4029), GAGguaauau (SEQ ID NO: 1897), UAGguuggug (SEQ ID NO: 4030), AAGguccaac (SEQ ID NO: 4031), UAGgugagga (SEQ ID NO: 2593), GUGguaaguu (SEQ ID NO: 2354), AGUgugagag (SEQ ID NO: 831), AAUguacaug (SEQ ID NO: 497), UUGgcaggug (SEQ ID NO: 4032), UAGguuauug (SEQ ID NO: 4033), CAGguacuga (SEQ ID NO: 1191), GCGguggguc (SEQ ID NO: 4034), UGUguaagau (SEQ ID NO: 4035), GAGgugagua (SEQ ID NO: 2025), GCAgccccgg (SEQ ID NO: 4036), CAGgugcuaa (SEQ ID NO: 4037), AGUguaagag (SEQ ID NO: 815), CAGguacauc (SEQ ID NO: 4038), CAGgugggac (SEQ ID NO: 1403), AGGguaaaua (SEQ ID NO: 727), UAAguaauua (SEQ ID NO: 4039), CAGguaaccg (SEQ ID NO: 1132), AAGguuugca (SEQ ID NO: 461), UAGgugguuu (SEQ ID NO: 4040), CAGgugaccg (SEQ ID NO: 1327), UGUguaagcu (SEQ ID NO: 4041), GGAgugaguc (SEQ ID NO: 2227), AGGguaggag (SEQ ID NO: 752), AGGgugggug (SEQ ID NO: 802), AAGgucugag (SEQ ID NO: 313), GAUguaauau (SEQ ID NO: 4042), GGGguaauua (SEQ ID NO: 4043), UAGguaggua (SEQ ID NO: 2524), GAGgcaagua (SEQ ID NO: 1858), GAGguaagga (SEQ ID NO: 1889), UAGguacuac (SEQ ID NO: 4044), UCGgugggug (SEQ ID NO: 4045), AAGgugugga (SEQ ID NO: 401), CAGgucugcc (SEQ ID NO: 1305), UAAgugagcc (SEQ ID NO: 4046), GAAguaaguu (SEQ ID NO: 1820), GAAguaagcc (SEQ ID NO: 1815), UAGgugcgac (SEQ ID NO: 4047), GAGguauggc (SEQ ID NO: 4048), GCAguaagaa (SEQ ID NO: 2145), CAGgugugga (SEQ ID NO: 1438), UUGguaacgu (SEQ ID NO: 4049), GCUguaaaaa (SEQ ID NO: 4050), UUGguuagua (SEQ ID NO: 4051), AUAguaaggg (SEQ ID NO: 4052), UUGguacuag (SEQ ID NO: 4053), CGGgcagccg (SEQ ID NO: 4054), CAGgugcugg (SEQ ID NO: 1389), UAUgugaguu (SEQ ID NO: 2673), CAGgucuggg (SEQ ID NO: 4055), UAAguaagaa (SEQ ID NO: 2415), AAGguuauua (SEQ ID NO: 4056), AGAguaaagc (SEQ ID NO: 4057), AGAgugugag (SEQ ID NO: 4058), UAGgugcgag (SEQ ID NO: 4059), CAAguaaacg (SEQ ID NO: 4060), AAGguacgua (SEQ ID NO: 4061), CUGgugagua (SEQ ID NO: 1759), CCAguaugua (SEQ ID NO: 4062), UUGgugagug (SEQ ID NO: 3006), UGAguaagua (SEQ ID NO: 2772), GAGguuagca (SEQ ID NO: 4063), GUGguaagcc (SEQ ID NO: 4064), CUGguauggc (SEQ ID NO: 1734), AAAguaacac (SEQ ID NO: 8), CAGguacuaa (SEQ ID NO: 1186), UCUguaaguu (SEQ ID NO: 2747), GAGgugaggg (SEQ ID NO: 2024), ACUgugggua (SEQ ID NO: 647), GAUguuugug (SEQ ID NO: 4065), CAGgugucaa (SEQ ID NO: 4066), CAGgucacca (SEQ ID NO: 4067), CCGgugagua (SEQ ID NO: 4068), UUGguaaaua (SEQ ID NO: 4069), CAGgugggggg (SEQ ID NO: 1411), ACUgcaggug (SEQ ID NO: 4070), UAGguauguu (SEQ ID NO: 2554), GGAgcaagug (SEQ ID NO: 4071), UCGgugccuc (SEQ ID NO: 4072), CAAguaacuu (SEQ ID NO: 4073), GAGguaacca (SEQ ID NO: 1879), CAGguaauau (SEQ ID NO: 1151), GGAguaagaa (SEQ ID NO: 4074), GAGguaccuu (SEQ ID NO: 1914), AGGguaagga (SEQ ID NO: 737), CCUgugaguc (SEQ ID NO: 1609), GAGguaaugg (SEQ ID NO: 1900), AUGguguguc (SEQ ID NO: 4075), GGGgugagua (SEQ ID NO: 4076), AGGgucaggu (SEQ ID NO: 4077), UGGguaaggg (SEQ ID NO: 2839), AGGguagguu (SEQ ID NO: 759), AUAgugaguu (SEQ ID NO: 4078), CCCguaggcu (SEQ ID NO: 4079), ACAguaugua (SEQ ID NO: 553), GACgugugua (SEQ ID NO: 4080), GCGgugagga (SEQ ID NO: 4081), CAGgugaccc (SEQ ID NO: 1326), UAAguuuagu (SEQ ID NO: 4082), ACAguugagu (SEQ ID NO: 570), CGGgugaggg (SEQ ID NO: 1639), CAGguggauu (SEQ ID NO: 1398), CGGguagagg (SEQ ID NO: 4083), UAGgugcgug (SEQ ID NO: 2608), GGGguaagaa (SEQ ID NO: 2243), GAGguggggu (SEQ ID NO: 4084), CACgugguu (SEQ ID NO: 4085), ACGguaauug (SEQ ID NO: 4086), AGAgugaguc (SEQ ID NO: 705), UUGgcuccaa (SEQ ID NO: 4087), AAGgugaugc (SEQ ID NO: 355), AAGguugguc (SEQ ID NO: 448), AGCguaaguu (SEQ ID NO: 4088), AUUguaugua (SEQ ID NO: 1006), UCAguuaagu (SEQ ID NO: 4089), CAAguacgug (SEQ ID NO: 4090), CAGgugcgug (SEQ ID NO: 1382), CAGguaggua (SEQ ID NO: 1220), AUGguggggu (SEQ ID NO: 4091), AUGgugaguu (SEQ ID NO: 964), CAGguaauca (SEQ ID NO: 4092), AAGguagggu (SEQ ID NO: 226), CAGgccaagg (SEQ ID NO: 4093), GUGgugagag (SEQ ID NO: 4094), AAGguuggug (SEQ ID NO: 449), CAGguacucu (SEQ ID NO: 1190), UAGgcaugug (SEQ ID NO: 4095), UUGguaccuu (SEQ ID NO: 4096), CUGgugugcc (SEQ ID NO: 4097), ACAguugcca (SEQ ID NO: 4098), UUGguaauau (SEQ ID NO: 4099), GAGgugcaug (SEQ ID NO: 4100), UUGguuugua (SEQ ID NO: 3028), UUGguaagug (SEQ ID NO: 2963), UGUgugugug (SEQ ID NO: 4101), GUGguuugua (SEQ ID NO: 2398), GCGguacaca (SEQ ID NO: 4102), AGAguaugcu (SEQ ID NO: 4103), UUUguaagua (SEQ ID NO: 3038), UCUgugcggg (SEQ ID NO: 4104), AAGgucagug (SEQ ID NO: 295), GAGguaggaa (SEQ ID NO: 1930), GCGguuagca (SEQ ID NO: 4105), AGGgugaggg (SEQ ID NO: 793), GAAgugagua (SEQ ID NO: 4106), CAGgugacag (SEQ ID NO: 4107), AAGgugauua (SEQ ID NO: 357), GAGgccagcc (SEQ ID NO: 4108), GAGgucuccu (SEQ ID NO: 4109), UAGguauuac (SEQ ID NO: 2556), CAUguaagag (SEQ ID NO: 1519), CUGguagggc (SEQ ID NO: 4110), GAAguaagua (SEQ ID NO: 1818), CGGguaagug (SEQ ID NO: 4111), CAGguaaucu (SEQ ID NO: 4112), GUGguaggua (SEQ ID NO: 4113), CAGgugggua (SEQ ID NO: 1413), AAGgccagug (SEQ ID NO: 4114), AAAgugaauc (SEQ ID NO: 4115), ACGguuacgu (SEQ ID NO: 4116), AUGguaggaa (SEQ ID NO: 917), CGGgugagac (SEQ ID NO: 4117), GAGguuggaa (SEQ ID NO: 2099), UGGgugagcc (SEQ ID NO: 2871), CCAgugagua (SEQ ID NO: 1564), CUAguacgag (SEQ ID NO: 4118), CAGguaugac (SEQ ID NO: 1248), GCUgugaggu (SEQ ID NO: 4119), CUGguaugaa (SEQ ID NO: 4120), GGUguacgac (SEQ ID NO: 4121), CUUgugagug (SEQ ID NO: 4122), GUGgugagca (SEQ ID NO: 2380), CUGguaacuu (SEQ ID NO: 1696), CAGguacuau (SEQ ID NO: 1188), AGGguaaggg (SEQ ID NO: 739), UUGguuaguu (SEQ ID NO: 3025), GGUguaagca (SEQ ID NO: 2302), UCGgugagga (SEQ ID NO: 4123), UGGguaaaca (SEQ ID NO: 4124), UCGguacgug (SEQ ID NO: 4125), UAGguagcag (SEQ ID NO: 4126), CUGguaaggc (SEQ ID NO: 1704), GUGguaagga (SEQ ID NO: 2349), UAAguaagca (SEQ ID NO: 2418), GAGguuccaa (SEQ ID NO: 4127), CUGguaugga (SEQ ID NO: 4128), GGGgugggua (SEQ ID NO: 2288), CAGguuuccc (SEQ ID NO: 4129), CAGgucucug (SEQ ID NO: 4130), GAGgugagga (SEQ ID NO: 2022), CUUguggguu (SEQ ID NO: 1805), AUGgugagac (SEQ ID NO: 953), CAGgugaagg (SEQ ID NO: 1319), GCGguagggg (SEQ ID NO: 4131), GUUguuuccc (SEQ ID NO: 4132), AAAgcaucca (SEQ ID NO: 4133), GUGguagguu (SEQ ID NO: 2367), AAGgugugaa (SEQ ID NO: 398), CAGguacagu (SEQ ID NO: 1167), AAGguaccaa (SEQ ID NO: 182), UUGguaauug (SEQ ID NO: 2969), AAGgugcuca (SEQ ID NO: 4134), AAGguucaac (SEQ ID NO: 4135), CAGguuuaca (SEQ ID NO: 4136), GCUguaagug (SEQ ID NO: 2195), AGGguauguc (SEQ ID NO: 769), GAGgucgggg (SEQ ID NO: 1996), AAGgugccug (SEQ ID NO: 363), AAGguaaaaa (SEQ ID NO: 119), GUGgugaguu (SEQ ID NO: 2385), UAGguaagaa (SEQ ID NO: 4137), AGGguauccu (SEQ ID NO: 4138), GUGguaauau (SEQ ID NO: 4139), UCUguaagua (SEQ ID NO: 2744), UGGguaugga (SEQ ID NO: 4140), AUGguaugga (SEQ ID NO: 935), GACgugagcc (SEQ ID NO: 1854), CUGguuuggc (SEQ ID NO: 4141), AUGguauauc (SEQ ID NO: 4142), AAAguaaacu (SEQ ID NO: 4143), AGCgugagug (SEQ ID NO: 721), CUGguauaga (SEQ ID NO: 4144), CAGgugggga (SEQ ID NO: 1409), AGAguauguu (SEQ ID NO: 696), UAGguacuug (SEQ ID NO: 4145), GCAguaggug (SEQ ID NO: 4146), AGUguauguc (SEQ ID NO: 4147), AAGguuaagc (SEQ ID NO: 413), CUGguggccu (SEQ ID NO: 4148), GAAgugaguc (SEQ ID NO: 1839), UUGguguaag (SEQ ID NO: 4149), CAGguaagaa (SEQ ID NO: 1138), CGGgucucgg (SEQ ID NO: 4150), GAGgugcaca (SEQ ID NO: 2035), CUCguuaguu (SEQ ID NO: 4151), AAGgugauca (SEQ ID NO: 352), UAUguaagaa (SEQ ID NO: 2649), GAGgugcuug (SEQ ID NO: 2047), CAGgugguca (SEQ ID NO: 4152), ACGguaaguc (SEQ ID NO: 4153), ACAguaaugu (SEQ ID NO: 4154), CCUguaaggu (SEQ ID NO: 4155), GAGguuaagu (SEQ ID NO: 4156), UCGguaugug (SEQ ID NO: 2725), UGGguauguu (SEQ ID NO: 2863), AAGguauuac (SEQ ID NO: 268), CAGgugaggg (SEQ ID NO: 1343), UUGguaaaca (SEQ ID NO: 4157), AAGguagugu (SEQ ID NO: 4158), GAGguguggc (SEQ ID NO: 4159), CAGguacgga (SEQ ID NO: 4160), AAGgucauca (SEQ ID NO: 4161), CAAguaggca (SEQ ID NO: 4162), CAGgugaaac (SEQ ID NO: 4163), CAGguacugc (SEQ ID NO: 1192), AAUgcaagug (SEQ ID NO: 4164), CAUguaauuc (SEQ ID NO: 4165), AAGguaugcu (SEQ ID NO: 259), CUGgugaguu (SEQ ID NO: 1762), CAGgugguuu (SEQ ID NO: 4166), UGUgugagua (SEQ ID NO: 2922), AAGgucggug (SEQ ID NO: 4167), AUGguaaauu (SEQ ID NO: 883), AGGguauuac (SEQ ID NO: 771), AGUguaugga (SEQ ID NO: 4168), AACguaagau (SEQ ID NO: 4169), GUGguaaggu (SEQ ID NO: 4170), ACUguuagua (SEQ ID NO: 4171), CAGguaucag (SEQ ID NO: 1239), AAGguuaguu (SEQ ID NO: 425), CUGgugagcu (SEQ ID NO: 1754), UUGgugagcu (SEQ ID NO: 4172), UGUguacgua (SEQ ID NO: 4173), GAGgucagcc (SEQ ID NO: 4174), GAGguagaau (SEQ ID NO: 4175), AAGguaugag (SEQ ID NO: 255), UAGguauuuc (SEQ ID NO: 2563), UGUguaacac (SEQ ID NO: 4176), AGUguaaggc (SEQ ID NO: 4177), GAGgucugcu (SEQ ID NO: 4178), AAGguuagca (SEQ ID NO: 418), CAGguaaaug (SEQ ID NO: 1127), AACguaagcu (SEQ ID NO: 4179), CAGgucugca (SEQ ID NO: 4180), CAGguauugu (SEQ ID NO: 1267), GUGguaauuc (SEQ ID NO: 2356), GAGguauaug (SEQ ID NO: 1951), GCCgugagcc (SEQ ID NO: 4181), GAGguaagag (SEQ ID NO: 1883), UGAguaugua (SEQ ID NO: 2787), CAGguaaggg (SEQ ID NO: 1145), GAGguaaauu (SEQ ID NO: 1876), CAGgcaacuu (SEQ ID NO: 4182), UGUguaaguc (SEQ ID NO: 2908), CAGgugcgcu (SEQ ID NO: 4183), CGGguaaacc (SEQ ID NO: 4184), CCGgucaguc (SEQ ID NO: 4185), UAGguggggcg (SEQ ID NO: 4186), GCGgucaguu (SEQ ID NO: 4187), GGGgugggguc (SEQ ID NO: 4188), AGCguaauag (SEQ ID NO: 4189), ACGgugaguc (SEQ ID NO: 4190), CUGguacuug (SEQ ID NO: 1722), CAGguuggua (SEQ ID NO: 4191), AGAguaugug (SEQ ID NO: 695), CUGgugggua (SEQ ID NO: 1771), GAGguggcuu (SEQ ID NO: 4192), AUAguauuga (SEQ ID NO: 4193), UGAgucgucc (SEQ ID NO: 4194), CAGgugcucu (SEQ ID NO: 4195), UACguaauau (SEQ ID NO: 4196), GCUgucccuga (SEQ ID NO: 4197), CAGgcugcac (SEQ ID NO: 4198), CUGgugcgcu (SEQ ID NO: 1766), GCGguaagaa (SEQ ID NO: 4199), UAAguuacuu (SEQ ID NO: 4200), GAAgugagug (SEQ ID NO: 1840), UAGgcaaguc (SEQ ID NO: 2460), UAAguaaaua (SEQ ID NO: 4201), ACGgugagug (SEQ ID NO: 607), CAGguagguu (SEQ ID NO: 1223), GGGguauaac (SEQ ID NO: 4202), GUUgugaguu (SEQ ID NO: 2410), CAUgugagua (SEQ ID NO: 1539), GAGgugcauu (SEQ ID NO: 4203), AAGguuugua (SEQ ID NO: 466), UCGguaaugu (SEQ ID NO: 4204), CGAguaaggg (SEQ ID NO: 1616), GAGgcacgga (SEQ ID NO: 4205), AGGgugugga (SEQ ID NO: 4206), CAGguauggu (SEQ ID NO: 1257), AAGguagaaa (SEQ ID NO: 203), CAGgugccug (SEQ ID NO: 1373), UGGguauaug (SEQ ID NO: 4207), UGAgugagac (SEQ ID NO: 4208), UGGguaauuu (SEQ ID NO: 2847), AUGguaaaua (SEQ ID NO: 881), AAGgcaaagg (SEQ ID NO: 4209), AGUguuuguu (SEQ ID NO: 4210), AUGguauugg (SEQ ID NO: 4211), CUGgugaggc (SEQ ID NO: 1756), UUGguaaaau (SEQ ID NO: 2948), ACAgugaguu (SEQ ID NO: 563), CAGgugcugu (SEQ ID NO: 4212), GAGguuaaga (SEQ ID NO: 2080), AGAguaagaa (SEQ ID NO: 659), GAGguccgcg (SEQ ID NO: 4213), GUGgugagga (SEQ ID NO: 2382), CAGgugagcc (SEQ ID NO: 1338), CAGgugacau (SEQ ID NO:

1324), AUGgcaagcu (SEQ ID NO: 4214), UCGguaauau (SEQ ID NO: 4215), CAGgcaacaa (SEQ ID NO: 4216), GGGguaggga (SEQ ID NO: 2257), CUGgucucgc (SEQ ID NO: 4217), UAGguaacga (SEQ ID NO: 4218), CGGguaaggu (SEQ ID NO: 4219), UAGguaaugc (SEQ ID NO: 4220), CAGgcaagaa (SEQ ID NO: 1099), ACAguaggua (SEQ ID NO: 4221), CAAguaugag (SEQ ID NO: 1049), GCUguucgaa (SEQ ID NO: 4222), AAGguuaugc (SEQ ID NO: 4223), GAUgugaguu (SEQ ID NO: 2136), CAGguggaga (SEQ ID NO: 1396), AGAguuaguu (SEQ ID NO: 4224), UGAgugugcg (SEQ ID NO: 4225), GAGguacagc (SEQ ID NO: 1907), CAGguaagac (SEQ ID NO: 1139), CAUgugcuuu (SEQ ID NO: 4226), AGGguguguu (SEQ ID NO: 4227), ACAguuaagg (SEQ ID NO: 4228), ACAgugaggg (SEQ ID NO: 4229), GAUguauacc (SEQ ID NO: 4230), UUAguaagcu (SEQ ID NO: 4231), CAGguaagau (SEQ ID NO: 1141), AGAgcugcgu (SEQ ID NO: 4232), GAGgcaaguu (SEQ ID NO: 1860), GAAguaagug (SEQ ID NO: 1819), AAGgugaaaa (SEQ ID NO: 4233), AAGguaccua (SEQ ID NO: 4234), GAGguaucag (SEQ ID NO: 4235), AUGguaugua (SEQ ID NO: 4236), AAGguaugaa (SEQ ID NO: 253), UUGgugagcc (SEQ ID NO: 4237), AAGguuagga (SEQ ID NO: 420), AGGguaugua (SEQ ID NO: 768), CAGguaccga (SEQ ID NO: 4238), AGAguaaacu (SEQ ID NO: 4239), AAGgugcaua (SEQ ID NO: 4240), AAGguaaugu (SEQ ID NO: 167), CCGgugugug (SEQ ID NO: 4241), AGGguaaauu (SEQ ID NO: 729), GGGguuuggc (SEQ ID NO: 4242), CAGguacacg (SEQ ID NO: 1164), UUGguaacca (SEQ ID NO: 4243), GAGgucaggu (SEQ ID NO: 1986), UCUguuggua (SEQ ID NO: 4244), CAGguuaguu (SEQ ID NO: 1458), UUGguauguc (SEQ ID NO: 4245), AAGgugcguc (SEQ ID NO: 4246), AGGguaagaa (SEQ ID NO: 733), UUUguaagcc (SEQ ID NO: 4247), AAGgucaggu (SEQ ID NO: 292), CUGguaaacu (SEQ ID NO: 4248), UCGguaauuu (SEQ ID NO: 4249), CUGguaggcu (SEQ ID NO: 4250), GAGgucugua (SEQ ID NO: 4251), GAGguacuuu (SEQ ID NO: 1922), CUGguaaagg (SEQ ID NO: 4252), CGGgugugug (SEQ ID NO: 1650), CAGguguggu (SEQ ID NO: 4253), UCGguacguc (SEQ ID NO: 4254), CAGgugccag (SEQ ID NO: 4255), GGGgugagaa (SEQ ID NO: 2275), ACAgcuagua (SEQ ID NO: 4256), AAGguauagc (SEQ ID NO: 4257), CUGguaggag (SEQ ID NO: 4258), GCUguacgua (SEQ ID NO: 4259), AAGguaaagg (SEQ ID NO: 128), CAAgcacgag (SEQ ID NO: 4260), CUAguaagac (SEQ ID NO: 4261), CCCguaagcg (SEQ ID NO: 4262), CAAgugugag (SEQ ID NO: 1078), AUGguaaggg (SEQ ID NO: 897), AAGgugaggg (SEQ ID NO: 345), CAAguaggua (SEQ ID NO: 1041), GGUguugcug (SEQ ID NO: 2321), GAGguacugu (SEQ ID NO: 1920), UAGguaagau (SEQ ID NO: 2484), CAGgugcgaa (SEQ ID NO: 1374), GAGguccagg (SEQ ID NO: 4263), UUGguauaca (SEQ ID NO: 2982), GGAgugagua (SEQ ID NO: 2226), GAGgugagau (SEQ ID NO: 2017), AAGguggggc (SEQ ID NO: 4264), CAGguaaacg (SEQ ID NO: 4265), UCGguaacuu (SEQ ID NO: 4266), CAGguaaauu (SEQ ID NO: 1128), GAGgugcgca (SEQ ID NO: 4267), ACUgugagua (SEQ ID NO: 643), ACGgugugac (SEQ ID NO: 4268), GUGguaaguc (SEQ ID NO: 2352), CAGguaggca (SEQ ID NO: 1215), CAGgucagca (SEQ ID NO: 1277), GUGguaugug (SEQ ID NO: 4269), AAAguaucug (SEQ ID NO: 4270), CGGguaugua (SEQ ID NO: 4271), AAGguaauaa (SEQ ID NO: 157), GAGgugggga (SEQ ID NO: 2060), GCUguaggug (SEQ ID NO: 2197), GAAgugaguu (SEQ ID NO: 1841), AAAguauuua (SEQ ID NO: 4272), UAUguaagua (SEQ ID NO: 2653), ACGguaugag (SEQ ID NO: 4273), CUGgugagug (SEQ ID NO: 1761), AGAguaaaau (SEQ ID NO: 4274), GCUguauggc (SEQ ID NO: 4275), AUGguaaacc (SEQ ID NO: 879), GCAguaauaa (SEQ ID NO: 4276), UAAguauuua (SEQ ID NO: 4277), AAUgucagug (SEQ ID NO: 515), AUUgcaggag (SEQ ID NO: 4278), CCGguaagaa (SEQ ID NO: 4279), AAGgcaaguu (SEQ ID NO: 101), GAGguuuguc (SEQ ID NO: 4280), AAGguaacug (SEQ ID NO: 139), AAAguaugag (SEQ ID NO: 4281), GAUguuagua (SEQ ID NO: 4282), CAGgugggguc (SEQ ID NO: 1414), AAGguaccga (SEQ ID NO: 4283), CCAguaauua (SEQ ID NO: 4284), GUGguaugcg (SEQ ID NO: 4285), AUGgugcgcu (SEQ ID NO: 4286), CAGgucuaug (SEQ ID NO: 4287), AAGguauuua (SEQ ID NO: 274), CUAguaagau (SEQ ID NO: 4288), AGAguaauuu (SEQ ID NO: 675), GAGguaacgu (SEQ ID NO: 4289), AAGguagcca (SEQ ID NO: 212), CUGgucccgg (SEQ ID NO: 4290), GAGguccuuc (SEQ ID NO: 4291), ACGgucaccc (SEQ ID NO: 4292), AAGguaauac (SEQ ID NO: 158), CAGgugcaug (SEQ ID NO: 1367), AUGguaauag (SEQ ID NO: 4293), UUUguaacac (SEQ ID NO: 4294), UGGguaugau (SEQ ID NO: 4295), CAGgcccccc (SEQ ID NO: 4296), AGAguaguaa (SEQ ID NO: 4297), AGUguaagaa (SEQ ID NO: 814), GAAguauguu (SEQ ID NO: 1833), CAGgugugca (SEQ ID NO: 1434), UUGgugaggg (SEQ ID NO: 3003), UGGguugguu (SEQ ID NO: 4298), CAGguacgua (SEQ ID NO: 1184), GAGgugcggc (SEQ ID NO: 4299), UCUguacggg (SEQ ID NO: 4300), CGGgugcgug (SEQ ID NO: 4301), UACguaagug (SEQ ID NO: 2455), CAUguaagga (SEQ ID NO: 4302), CAGgugacgg (SEQ ID NO: 1329), GAUguaugcu (SEQ ID NO: 4303), UCUgcaauuc (SEQ ID NO: 4304), UGAguaaggc (SEQ ID NO: 2770), GAGguauauu (SEQ ID NO: 1952), AGAgugaguu (SEQ ID NO: 707), AAGguaagcu (SEQ ID NO: 148), UAGgugaagu (SEQ ID NO: 2580), CAGguuagua (SEQ ID NO: 1455), UAUguaagug (SEQ ID NO: 2655), UUGgugggggg (SEQ ID NO: 4305), UGAgcucaaa (SEQ ID NO: 4306), UCGguaugua (SEQ ID NO: 4307), UAAguaugcc (SEQ ID NO: 4308), AAUguaagua (SEQ ID NO: 489), CAGguuugca (SEQ ID NO: 4309), ACGgugagag (SEQ ID NO: 4310), CAGguguuuu (SEQ ID NO: 4311), GUGgugagcc (SEQ ID NO: 4312), AGGguacaua (SEQ ID NO: 4313), UAGguaaccc (SEQ ID NO: 4314), GUGgucagua (SEQ ID NO: 4315), CUGgugagcc (SEQ ID NO: 4316), CAGgugcuua (SEQ ID NO: 1390), AUAgucguga (SEQ ID NO: 4317), AUAgugagug (SEQ ID NO: 862), GAGgucaaaa (SEQ ID NO: 4318), CGUguagcuu (SEQ ID NO: 4319), CAGguguuug (SEQ ID NO: 4320), CAGguuggac (SEQ ID NO: 4321), CAGguaagcu (SEQ ID NO: 4322), AGGgucagaa (SEQ ID NO: 4323), CACguauguc (SEQ ID NO: 4324), CACgugagug (SEQ ID NO: 1098), GGGguacgga (SEQ ID NO: 4325), AAGgcaggac (SEQ ID NO: 4326), GAGgugaagc (SEQ ID NO: 4327), GAGguuugaa (SEQ ID NO: 4328), CAGguaagug (SEQ ID NO: 1148), CAGguaacca (SEQ ID NO: 1131), CAGguacucc (SEQ ID NO: 1189), AAGgugcuuu (SEQ ID NO: 371), GAGguaaaua (SEQ ID NO: 1873), GAGgcaggug (SEQ ID NO: 4329), GAGguucgga (SEQ ID NO: 4330), CAGguauuug (SEQ ID NO: 1270), CAGguaaaua (SEQ ID NO: 1125), CAGgugaugu (SEQ ID NO: 1354), CAGgugauac (SEQ ID NO: 4331), GAGgugaggc (SEQ ID NO: 2023), AGGgugggggg (SEQ ID NO: 4332), UAAguaaguu (SEQ ID NO: 2425), UGGgugaaca (SEQ ID NO: 4333), UAGguacugc (SEQ ID NO: 4334), CAGgcuccug (SEQ ID NO: 4335), AGGguaggca (SEQ ID NO: 753), CAGgugcccg (SEQ ID NO: 1371), GAGguacauc (SEQ ID NO: 4336), AGGgugugug (SEQ ID NO: 804), AAGguaguaa (SEQ ID NO: 231), UGGguaugag (SEQ ID NO: 2859), GGGgugugug (SEQ ID NO: 2294), CUAguaggug (SEQ ID NO: 4337), GAGgcaagga (SEQ ID NO: 4338), AAGgcaagac (SEQ ID NO: 4339), AAAgugcggu (SEQ ID NO: 4340), AAGguugguu (SEQ ID NO: 450), GAGguuaaug (SEQ ID NO: 4341), UUGgugaguc (SEQ ID NO: 3005), UCGguuagcu (SEQ ID NO: 2738), GCAguaagca (SEQ ID NO: 4342), AAGgcaagca (SEQ ID NO: 4343), ACAguaagcu (SEQ ID NO: 4344), GAGguaacag (SEQ ID NO: 1878), AAAguacgua (SEQ ID NO: 4345), GAGguaauac (SEQ ID NO: 1896), UUGguaggug (SEQ ID NO: 2980), CUGguuaguc (SEQ ID NO: 4346), GAGgugacgc (SEQ ID NO: 4347), ACAguaagga (SEQ ID NO: 4348), AAUguacuua (SEQ ID NO: 4349), GGGguacagu (SEQ ID NO: 4350), CGUguaugug (SEQ ID NO: 4351), UCCguagguu (SEQ ID NO: 4352), GAGgugggucg (SEQ ID NO: 4353), UCAgugaguc (SEQ ID NO: 4354), AAAguaagca (SEQ ID NO: 15), GAGgucuggu (SEQ ID NO: 1999), GAGguaauua (SEQ ID NO: 4355), GUAguaagua (SEQ ID NO: 2323), AAGgugggga (SEQ ID NO: 382), UCUgugagca (SEQ ID NO: 4356), GAAguucgug (SEQ ID NO: 4357), ACGgugaggc (SEQ ID NO: 4358), UCAgugagua (SEQ ID NO: 2699), UAGguaguug (SEQ ID NO: 4359), GGUgucuggg (SEQ ID NO: 4360), GGGguaagug (SEQ ID NO: 2252), GAGgugggguu (SEQ ID NO: 2066), UGUgugaguu (SEQ ID NO: 4361), CAUguaagua (SEQ ID NO: 1522), AAGguaggug (SEQ ID NO: 229), AAUguaggag (SEQ ID NO: 4362), GAGgcacguc (SEQ ID NO: 4363), CAAguacauu (SEQ ID NO: 4364), UUGguacaga (SEQ ID NO: 4365), GAGguaguag (SEQ ID NO: 1941), AAAgugaggg (SEQ ID NO: 57), UUGgucagug (SEQ ID NO: 4366), AGGgugaguc (SEQ ID NO: 796), CAGgugaaca (SEQ ID NO: 1317), GGUgugggcc (SEQ ID NO: 4367), CGGgugagcu (SEQ ID NO: 4368), GGGgugaguc (SEQ ID NO: 2283), ACAgugagag (SEQ ID NO: 4369), AGGgugaggu (SEQ ID NO: 794), GCUguaaguc (SEQ ID NO: 2194), AUAguagguu (SEQ ID NO: 4370), CAGgcaugug (SEQ ID NO: 1114), AAGguaaguu (SEQ ID NO: 156), CAGguccgug (SEQ ID NO: 4371), GAGgcaggua (SEQ ID NO: 4372), AUGguggaag (SEQ ID NO: 4373), AUGgugggcg (SEQ ID NO: 4374), GAGgugagaa (SEQ ID NO: 2014), AGUgugagca (SEQ ID NO: 832), UUGguaagua (SEQ ID NO: 2962), CAAguaagca (SEQ ID NO: 4375), GGUgugagcu (SEQ ID NO: 2313), CCCgugggua (SEQ ID NO: 4376), CAGguagaau (SEQ ID NO: 4377), CAGgcugagc (SEQ ID NO: 4378), CUGguggccc (SEQ ID NO: 4379), UGAguaagag (SEQ ID NO: 4380), CACguuagcu (SEQ ID NO: 4381), AAGgugaguc (SEQ ID NO: 348), AAGguagcuc (SEQ ID NO: 4382), UCGgugaguu (SEQ ID NO: 4383), GAGgcccuuc (SEQ ID NO: 4384), CAGguuaugc (SEQ ID NO: 4385), CCUguaagcu (SEQ ID NO: 4386), CAGgucuccu (SEQ ID NO: 4387), UAGguaggcu (SEQ ID NO: 4388), GGGguagggg (SEQ ID NO: 4389), AAGguaguga (SEQ ID NO: 4390), GAGguuguug (SEQ ID NO: 4391), CAGguugguu (SEQ ID NO: 1489), AAAguaagcc (SEQ ID NO: 16), ACAgugagug (SEQ ID NO: 562), UGGgugugau (SEQ ID NO: 4392), CCCguaacua (SEQ ID NO: 4393), AAGguguugc (SEQ ID NO: 408), AAAgcuggug (SEQ ID NO: 4394), GAGguauagu (SEQ ID NO: 4395), ACGguaagag (SEQ ID NO: 4396), AUGguacggu (SEQ ID NO: 913), GAGgccaguu (SEQ ID NO: 4397), GAGguaugcg (SEQ ID NO: 1960), UCGgugggag (SEQ ID NO: 4398), AAGguggaua (SEQ ID NO: 372), CCAguguggc (SEQ ID NO: 4399), AGGguaagug (SEQ ID NO: 742), UCUguaggcu (SEQ ID NO: 4400), CAGgcaagga (SEQ ID NO: 1102), CGGguaauuu (SEQ ID NO: 1628), AUUgugaguc (SEQ ID NO: 1010), CAGguaaacc (SEQ ID NO: 1121), AAGgucaauu (SEQ ID NO: 4401), AAGgugaaua (SEQ ID NO: 327), GUCguaagaa (SEQ ID NO: 4402), GCGguaaguc (SEQ ID NO: 4403), CUGguagagc (SEQ ID NO: 4404), GAGgucgguc (SEQ ID NO: 4405), CAGguaaaca (SEQ ID NO: 1120), AAGgcaagga (SEQ ID NO: 98), CAGgucgucu (SEQ ID NO: 4406), GGGguagggc (SEQ ID NO: 4407), CUGguacuaa (SEQ ID NO: 1721), GAGguagcug (SEQ ID NO: 1929), CUUgucagcu (SEQ ID NO: 4408), UAGguaaggc (SEQ ID NO: 2489), CUGguauuac (SEQ ID NO: 4409), UAAguacguc (SEQ ID NO: 4410), AAGguaagcc (SEQ ID NO: 146), ACGgugaaag (SEQ ID NO: 4411), CCAgccaaua (SEQ ID NO: 4412), CAGguuuguc (SEQ ID NO: 4413), AAGguauaau (SEQ ID NO: 239), AAGgucuuag (SEQ ID NO: 4414), AGGgugagcu (SEQ ID NO: 791), AAGguuaggg (SEQ ID NO: 4415), CGGguaaauu (SEQ ID NO: 4416), CAGguaacgg (SEQ ID NO: 4417), AGAgugugua (SEQ ID NO: 4418), ACAguaaguu (SEQ ID NO: 549), GAUguaauuu (SEQ ID NO: 4419), GAGguaggga (SEQ ID NO: 1934), UUGgcaagug (SEQ ID NO: 2945), AAAgugagga (SEQ ID NO: 4420), AAGguagugc (SEQ ID NO: 234), AGAguaauuc (SEQ ID NO: 674), GGAguaaaua (SEQ ID NO: 4421), GUGguaccca (SEQ ID NO: 4422), CAGguauugc (SEQ ID NO: 4423), GAUgugaggg (SEQ ID NO: 4424), CAAguaaauc (SEQ ID NO: 1017), CAGgugucuc (SEQ ID NO: 1428), AAGguaacag (SEQ ID NO: 4425), UUGguaaaag (SEQ ID NO: 4426), CAGguaucau (SEQ ID NO: 1240), ACGgugagac (SEQ ID NO: 4427), CUGguaugac (SEQ ID NO: 4428), CAGguucacu (SEQ ID NO: 4429), GAGgugauca (SEQ ID NO: 4430), AGUguaaguc (SEQ ID NO: 4431), AACguaagua (SEQ ID NO: 4432), AAAgugagug (SEQ ID NO: 60), GAGguacagg (SEQ ID NO: 4433), CAAguaauga (SEQ ID NO: 4434), GAUguaagga (SEQ ID NO: 4435), UCAguucccc (SEQ ID NO: 4436), GCGguaagga (SEQ ID NO: 4437), UAGguacuaa (SEQ ID NO: 4438), AAGgugaaag (SEQ ID NO: 321), ACUguaagug (SEQ ID NO: 4439), UGGguaugug (SEQ ID NO: 2862), AUGguaacag (SEQ ID NO: 884), CAGguagggu (SEQ ID NO: 1219), ACAguaagug (SEQ ID NO: 548), AAGgugcucc (SEQ ID NO: 366), AAGgugugcu (SEQ ID NO: 4440), AAGgugguga (SEQ ID NO: 4441), ACGgugcgcc (SEQ ID NO: 4442), AAGguauugc (SEQ ID NO: 4443), GGGguaugug (SEQ ID NO: 2267), CAGgugggcu (SEQ ID NO: 1408), GAGguauguu (SEQ ID NO: 1968), AACgugaaua (SEQ ID NO: 4444), CAGguaaugg (SEQ ID NO: 1154), UAGguaugau (SEQ ID NO: 4445), CAGgcaggug (SEQ ID NO: 1108), GGGguugguc (SEQ ID NO: 4446), AAGguauggg (SEQ ID NO: 262), UAAgugaggc (SEQ ID NO: 4447), CAAgugaucg (SEQ ID NO: 4448), AAAguacggg (SEQ ID NO: 4449), AGAgcuacag (SEQ ID NO: 4450), GAGgugggaa (SEQ ID NO: 2054), CAGguacuuu (SEQ ID NO: 1195), GAGgugagag (SEQ ID NO: 2016), CAGguaggguc (SEQ ID NO: 1221), UGGguacagc (SEQ ID NO: 4451), AAGgugucag (SEQ ID NO: 396), AAGgcaagaa (SEQ ID NO: 4452), GAGguaaaca (SEQ ID NO: 4453), AAGguaaagu (SEQ ID NO: 129), AAGguaguca (SEQ ID NO: 4454), CUGguauguc (SEQ ID NO: 4455), GAGguauggg (SEQ ID NO: 1963), AAGguauugu (SEQ ID NO: 273), CUGguacuga (SEQ ID NO: 4456), GAGguaagcu (SEQ ID NO: 1888), UGGgugggua (SEQ ID NO: 2883), CAGguucgug (SEQ ID NO: 4457), AAGguauggu (SEQ ID NO: 4458), CAGgugagca (SEQ ID NO: 1337), UGGguaaauu (SEQ ID NO: 2827), UGUguaggug (SEQ ID NO: 4459), UGUgugagcc (SEQ ID NO: 2921), CUGguaauau (SEQ ID NO: 4460), AAAguauguu (SEQ ID NO: 45), UGUguaagaa (SEQ ID NO: 2903), CUAgugagaa (SEQ ID NO: 4461), AGGguagguc (SEQ ID NO: 757), AAGgugggug (SEQ ID NO: 385), UCGguaagug (SEQ ID NO: 4462), AGUguaaaua (SEQ ID NO: 812), GAUguaagug (SEQ ID NO: 2122), AAGguuagug (SEQ ID NO: 424), UAGguaagca (SEQ ID NO: 2485), CAAgugagaa (SEQ ID NO: 1061), AGUguaagua (SEQ ID NO: 819), CAGgugaauc (SEQ ID NO: 1321), UGGgugagac (SEQ ID NO: 2868), AAGguagggc (SEQ ID NO: 224), CUGguuugug (SEQ ID NO: 1788), GCGguagggc (SEQ ID NO: 4463), GAGguaaucc (SEQ ID NO: 4464), AUUguaauaa (SEQ ID NO: 4465), CUGgugaaua (SEQ ID NO: 1748), AAGguuuaaa (SEQ ID NO: 4466), CCUguacugu (SEQ ID NO: 4467), GCGgugagcg (SEQ ID NO: 4468), AAGguaaucc (SEQ ID NO: 162), UAUgugagua (SEQ ID NO: 2671), CCCgugagug (SEQ ID NO: 1573), CAGgugcaga (SEQ ID NO: 1363), CAGgucaguu (SEQ ID NO: 1284), CAGguaggcu (SEQ ID NO: 4469), AAAguaagug (SEQ ID NO: 23), UAGguugguc (SEQ ID NO: 4470), CAGguugccu (SEQ ID NO: 4471), AAGguaugga (SEQ ID NO: 260), GGUguggacg (SEQ ID NO: 4472), AAAgugagaa (SEQ ID NO: 51), AGGgugagag (SEQ ID NO: 788), GAUguggcau (SEQ ID NO: 4473), UCGguaaggu (SEQ ID NO: 4474), GAGgugcguc (SEQ ID NO: 4475), CGGgugaguc (SEQ ID NO: 4476), AAGguacggg (SEQ ID NO: 190), GAGguucuug (SEQ ID NO: 4477), AAGgugcuug (SEQ ID NO: 4478), UAGguaugua (SEQ ID NO: 2551), AUGgucagca (SEQ ID NO: 4479), CGGguacuca (SEQ ID NO: 4480), AGGgugagga (SEQ ID NO: 792), AUCgugagua (SEQ ID NO: 869), UCAguaagua (SEQ ID NO: 2689), UAGguaaaua (SEQ ID NO: 2469), AAGguaauug (SEQ ID NO: 170), GAAgucagug (SEQ ID NO: 1835), CAGguacaaa (SEQ ID NO: 1160), AAAguuaauc (SEQ ID NO: 4481), AGCgugagcg (SEQ ID NO: 4482), CCGgcuggug (SEQ ID NO: 4483), AGUguaauuu (SEQ ID NO: 4484), UGAgccacuc (SEQ ID NO: 4485), GGGgucugua (SEQ ID NO: 4486), AUGgcauguc (SEQ ID NO: 4487), CGGguaaaga (SEQ ID NO: 4488), AGGguagcau (SEQ ID NO: 4489), CGGguaggag (SEQ ID NO: 1631), GAGguucgug (SEQ ID NO: 4490), UAAguuauuc (SEQ ID NO: 4491), UAUguaagau (SEQ ID NO: 2650), AAGguaguuu (SEQ ID NO: 237), CAGgugguau (SEQ ID NO: 4492), GUGguaauga (SEQ ID NO: 2355), AAGgugauuu (SEQ ID NO: 359), CAGgugaagu (SEQ ID NO: 4493), GUAguaauua (SEQ ID NO: 4494), AUGguuggug (SEQ ID NO: 4495), CCAguaagug (SEQ ID NO: 1557), UAGgugagag (SEQ ID NO: 2589), AUGgugaggc (SEQ ID NO: 959), AAAguuagug (SEQ ID NO: 72), AAGgugccuu (SEQ ID NO: 4496), UAGguaugag (SEQ ID NO: 2546), CAGgugugac (SEQ ID NO: 1431), CUGguggguu (SEQ ID NO: 1774), AUGguaagga (SEQ ID NO: 896), UCUguaagaa (SEQ ID NO: 2740), UCCgugaguu (SEQ ID NO: 4497), AAAgcaggua (SEQ ID NO: 4498), UAUgugagug (SEQ ID NO: 2672), CAGgugguagg (SEQ ID NO: 4499), CAGguuagac (SEQ ID NO: 4500), AUAguaagac (SEQ ID NO: 846), AAGguguugu (SEQ ID NO: 4501), GAGgucugug (SEQ ID NO: 4502), AAGguaagau (SEQ ID NO: 144), CAUguaaguu (SEQ ID NO: 1524), CUGguaauua (SEQ ID NO: 4503), CAGguaggcg (SEQ ID NO: 4504), AGAguaaguc (SEQ ID NO: 669), UGGgugagga (SEQ ID NO: 2872), AAUguaggua (SEQ ID NO: 4505), UAGguuagca (SEQ ID NO: 4506), GGGguaggua (SEQ ID NO: 2258), GAGguauugc (SEQ ID NO: 4507), AUUguacaca (SEQ ID NO: 4508), GAAguaggua (SEQ ID NO: 4509), GGAguaagcu (SEQ ID NO: 2212), UAGguaugug (SEQ ID NO: 2553), GAGgugaaua (SEQ ID NO: 2007), GAGgugggau (SEQ ID NO: 2056), AAGguaaucu (SEQ ID NO: 163), GGUgugaguu (SEQ ID NO: 4510), AACgugaguu (SEQ ID NO: 4511), GAGguaaccg (SEQ ID NO: 4512), UAGguaagga (SEQ ID NO: 2488), AUUguaagaa (SEQ ID NO: 4513), UGGgugagca (SEQ ID NO: 2870), AAGguaaggc (SEQ ID NO: 150), CCAguaucgu (SEQ ID NO: 4514), CCGgugggug (SEQ ID NO: 4515), GAGguagugu (SEQ ID NO: 4516), ACGgugggaa (SEQ ID NO: 4517), GAGgugaccu (SEQ ID NO: 2011), CACguaugua (SEQ ID NO: 4518), AGGgugggga (SEQ ID NO: 799), AAUguaaguc (SEQ ID NO: 490), AAAguuaagu (SEQ ID NO: 70), CAUgugagug (SEQ ID NO: 1541), AGAguauguc (SEQ ID NO: 694), GCGguaugac (SEQ ID NO: 4519), CGGgugaguu (SEQ ID NO: 1643), CCGguauuuu (SEQ ID NO: 4520), GAGguagaac (SEQ ID NO: 4521), UAGguaugaa (SEQ ID NO: 2545), CAGgcgcgug (SEQ ID NO: 4522), CAAguaaguc (SEQ ID NO: 1027), AGUguaagau (SEQ ID NO: 816), AAGguucuac (SEQ ID NO: 4523), CCAguaagua (SEQ ID NO: 1555), GAGguagcag (SEQ ID NO: 4524), CAGgucuguu (SEQ ID NO: 1312), CAGguacaau (SEQ ID NO: 1162), CCGguaaaga (SEQ ID NO: 1574), UAAgugcugu (SEQ ID NO: 4525), AGGgugagaa (SEQ ID NO: 786), CUCguaaggu (SEQ ID NO: 4526), CAGgucagcu (SEQ ID NO: 4527), CAGguaaggc (SEQ ID NO: 1144), AGGgugcagg (SEQ ID NO: 4528), GAGgugaaac (SEQ ID NO: 4529), AGGguaagua (SEQ ID NO: 740), AAUguaugcc (SEQ ID NO: 4530), AAGguaagca (SEQ ID NO: 145), ACGguacggu (SEQ ID NO: 587), AAGguaauga (SEQ ID NO: 164), UCUgcucaau (SEQ ID NO: 4531), ACGguaaugu (SEQ ID NO: 4532), AAGguaguug (SEQ ID NO: 4533), ACGguaagug (SEQ ID NO: 580), CAGgugauga (SEQ ID NO: 4534), GAGguaacac (SEQ ID NO: 4535), GAGguaggua (SEQ ID NO: 1937), CAGguaccuu (SEQ ID NO: 1179), CAGguaauaa (SEQ ID NO: 1150), UUGgugggug (SEQ ID NO: 3016), CUGguaauga (SEQ ID NO: 1710), UAGguaaguc (SEQ ID NO: 2492), AGGgugugac (SEQ ID NO: 4536), GAGgcaauaa (SEQ ID NO: 4537), GUGguaaagc (SEQ ID NO: 4538), CUGgugggcg (SEQ ID NO: 4539), GAUguauguu (SEQ ID NO: 2128), AGGgugagac (SEQ ID NO: 787), UCGgucagca (SEQ ID NO: 4540), AUGgugauua (SEQ ID NO: 4541), CGAgugugua (SEQ ID NO: 4542), CAGguuggug (SEQ ID NO: 1488), AGCgcaagua (SEQ ID NO: 4543), UGGguacguu (SEQ ID NO: 4544), GAGguauuug (SEQ ID NO: 1974), AGUguacaua (SEQ ID NO: 4545), AUGguaagua (SEQ ID NO: 898), ACAguagguu (SEQ ID NO: 4546), AAGgugagag (SEQ ID NO: 337), UUGgugaagu (SEQ ID NO: 4547), AAAguaugua (SEQ ID NO: 43), UGGguaagga (SEQ ID NO: 4548), UAGgugccuu (SEQ ID NO: 4549), and CCUgugggug (SEQ ID NO: 4550).

Additional exemplary gene sequences and splice site sequences (e.g., 5' splice site sequences) include UCCguaaguu (SEQ ID NO: 4551), GUGguaaacg (SEQ ID NO: 4552), CGGgugcggu (SEQ ID NO: 4553), CAUguacuuc (SEQ ID NO: 4554), AGAguaaagg (SEQ ID NO: 4555), CGCgugagua (SEQ ID NO: 4556), AGAgugggca (SEQ ID NO: 4557), AGAguaagcc (SEQ ID NO: 4558), AGAguaaaca (SEQ ID NO: 4559), GUGguuauga (SEQ ID NO: 4560), AGGguaauaa (SEQ ID NO: 4561), UGAguaagac (SEQ ID NO: 4562), AGAguuuguu (SEQ ID NO: 4563), CGGgucugca (SEQ ID NO: 4564), CAGguaaguc (SEQ ID NO: 4565), AAGguagaau (SEQ ID NO: 4566), CAGgucccuc (SEQ ID NO: 4567), AGAguaaugg (SEQ ID NO: 4568), GAGgucuaag (SEQ ID NO: 4569), AGAguagagu (SEQ ID NO: 4570), AUGgucagua (SEQ ID NO: 4571), GAGgccuggg (SEQ ID NO: 4572), AAGguguggc (SEQ ID NO: 4573), AGAgugaucu (SEQ ID NO: 4574), AAGguaucca (SEQ ID NO: 4575), UUCguaagua (SEQ ID NO: 4576), UAAgugggug (SEQ ID NO: 4577), GCCgugaacg (SEQ ID NO: 4578), GAGguugugg (SEQ ID NO: 4579), UAUguaugca (SEQ ID NO: 4580), UGUguaacaa (SEQ ID NO: 4581), AGGguauuag (SEQ ID NO: 4582), UGAguauauc (SEQ ID NO: 4583), AGAguuugug (SEQ ID NO: 4584), GAGgucgcug (SEQ ID NO: 4585), GAGgucaucg (SEQ ID NO: 4586), ACGguaaagc (SEQ ID NO: 4587), UGAguacuug (SEQ ID NO: 4588), CGAgucgccg (SEQ ID NO: 4589), CUGguacguc (SEQ ID NO: 4590), AGGguauugc (SEQ ID NO: 4591), GAAgugaaug (SEQ ID NO: 4592), CAGaugaguc (SEQ ID NO: 4593), UGGguauugg (SEQ ID NO: 4594), UGAguaaaga (SEQ ID NO: 4595), GUGguuccug (SEQ ID NO: 4596), UGAgcaagua (SEQ ID NO: 4597), UAUguaagag (SEQ ID NO: 4598), AAGgucuugc (SEQ ID NO: 4599), AAAgcaugug (SEQ ID NO: 4600), AGAguacagu (SEQ ID NO: 4601), GUGguaaucc (SEQ ID NO: 4602), CAGguagagg (SEQ ID NO: 4603), AAGguacaac (SEQ ID NO: 4604), UGGgcagcau (SEQ ID NO: 4605), CCGgucauca (SEQ ID NO: 4606), CCGguuugua (SEQ ID NO: 4607), UGAguaaggg (SEQ ID NO: 4608), GAAguaugua (SEQ ID NO: 4609), GGGguagcuc (SEQ ID NO: 4610), GCUguacaua (SEQ ID NO: 4611), CUGgucucuu (SEQ ID NO: 4612), GUGguaaaug (SEQ ID NO: 4613), AUCguaagug (SEQ ID NO: 4614), GAGgcaugua (SEQ ID NO: 4615), AAGgucuccc (SEQ ID NO: 4616), UGGgugcguu (SEQ ID NO: 4617), UGUguagguu (SEQ ID NO: 4618), GAAgugagca (SEQ ID NO: 4619), GGUguaauuu (SEQ ID NO: 4620), CUGgugaaau (SEQ ID NO: 4621), AUCguaaguc (SEQ ID NO: 4622), AGAguaaucc (SEQ ID NO: 4623), GGAguagguc (SEQ ID NO: 4624), GAGguaccaa (SEQ ID NO: 4625), CUUguaggug (SEQ ID NO: 4626), AAGguauaag (SEQ ID NO: 4627), AGAguuggua (SEQ ID NO: 4628), AUGguuugug (SEQ ID NO: 4629), UGGgucagau (SEQ ID NO: 4630), AGAguaggac (SEQ ID NO: 4631), AGAguagugu (SEQ ID NO: 4632), AGAguaggag (SEQ ID NO: 4633), CAGgucucua (SEQ ID NO: 4634), AAGguggaug (SEQ ID NO: 4635), UGGguaucaa (SEQ ID NO: 4636), GAUguaugga (SEQ ID NO: 4637), AAGguguuuc (SEQ ID NO: 4638), GCAguguaaa (SEQ ID NO: 4639), UUAguaugua (SEQ ID NO: 4640), UCUguaugca (SEQ ID NO: 4641), AAUguaaaau (SEQ ID NO: 4642), AGAguaaauu (SEQ ID NO: 4643), GGGguacuuu (SEQ ID NO: 4644), GAAguuugau (SEQ ID NO: 4645), AAAguagauu (SEQ ID NO: 4646), UGUguagagu (SEQ ID NO: 4647), UGGguaagcg (SEQ ID NO: 4648), CGGguucagg (SEQ ID NO: 4649), AGGguacgac (SEQ ID NO: 4650), UCGguaagaa (SEQ ID NO: 4651), AGGguuggca (SEQ ID NO: 4652), AAAguacagu (SEQ ID NO: 4653), UAAguuaagg (SEQ ID NO: 4654), AUGguaaugu (SEQ ID NO: 4655), GUGguuuuac (SEQ ID NO: 4656), AGAguaacaa (SEQ ID NO: 4657), AAGguagccc (SEQ ID NO: 4658), GCGgugaggc (SEQ ID NO: 4659), AUGguucagc (SEQ ID NO: 4660), AAGguacuua (SEQ ID NO: 4661), AAGguccgug (SEQ ID NO: 4662), UAGguaagcg (SEQ ID NO: 4663), AUGguaccuu (SEQ ID NO: 4664), GCCguggugg (SEQ ID NO: 4665), CUGgugcguc (SEQ ID NO: 4666), CAGguggaaa (SEQ ID NO: 4667), AAAgucugua (SEQ ID NO: 4668), GAGguaaccc (SEQ ID NO: 4669), AGAguauggg (SEQ ID NO: 4670), UAUgccccug (SEQ ID NO: 4671), AAGgugccag (SEQ ID NO: 4672), ACGgugcggc (SEQ ID NO: 4673), AGGguacuga (SEQ ID NO: 4674), AGAguaagcg (SEQ ID NO: 4675), CUGgcaaggg (SEQ ID NO: 4676), CCAgugugug (SEQ ID NO: 4677), GAGguagacg (SEQ ID NO: 4678), CGGgugcggg (SEQ ID NO: 4679), GAUguaagcu (SEQ ID NO: 4680), AUUguauuua (SEQ ID NO: 4681), UGCgugagug (SEQ ID NO: 4682), CUGgucuaua (SEQ ID NO: 4683), GAGgugcuag (SEQ ID NO: 4684), GAGgugccau (SEQ ID NO: 4685), CAGguacguc (SEQ ID NO: 4686), GAGguucagc (SEQ ID NO: 4687), AACguaagaa (SEQ ID NO: 4688), AGAguaguac (SEQ ID NO: 4689), AAGguaacgg (SEQ ID NO: 4690), UAGgugugac (SEQ ID NO: 4691), CCGguaauag (SEQ ID NO: 4692), CAGguaccag (SEQ ID NO: 4693), UUUguaauug (SEQ ID NO: 4694), AAUguacgaa (SEQ ID NO: 4695), CAGguaauga (SEQ ID NO: 4696), AUCgucaagg (SEQ ID NO: 4697), CUGguagaug (SEQ ID NO: 4698), GGGgugcagu (SEQ ID NO: 4699), AGUgugagaa (SEQ ID NO: 4700), GGGguuuuau (SEQ ID NO: 4701), CCUguccccu (SEQ ID NO: 4702), AUUgugaagu (SEQ ID NO: 4703), AAGguaaacg (SEQ ID NO: 4704), UACgucgugg (SEQ ID NO: 4705), AAGgugccau (SEQ ID NO: 4706), GGGgucccag (SEQ ID NO: 4707), UAUguauggu (SEQ ID NO: 4708), CGGguaauua (SEQ ID NO: 4709), CGGguacucc (SEQ ID NO: 4710), CAGgugacuu (SEQ ID NO: 4711), AGUgugggu (SEQ ID NO: 4712), AGAguauggc (SEQ ID NO: 4713), AAGgccaaca (SEQ ID NO: 4714), AAAgcaagua (SEQ ID NO: 4715), UCAguagguc (SEQ ID NO: 4716), GUGguggcgg (SEQ ID NO: 4717), CAUguauccu (SEQ ID NO: 4718), UCGgugagcc (SEQ ID NO: 4719), AUAguugggu (SEQ ID NO: 4720), AAUguuagcu (SEQ ID NO: 4721), AUGgugaaug (SEQ ID NO: 4722), CGGguaaugu (SEQ ID NO: 4723), UCUguaggug (SEQ ID NO: 4724), CCGgugaggc (SEQ ID NO: 4725), UGAguccacu (SEQ ID NO: 4726), CUAguaagag (SEQ ID NO: 4727), CGGguggggc (SEQ ID NO: 4728), CGAguaagca (SEQ ID NO: 4729), UGUgccaauu (SEQ ID NO: 4730), UCGguaagcc (SEQ ID NO: 4731), UAUguaggug (SEQ ID NO: 4732), UUGgugggcc (SEQ ID NO: 4733), GAGgcugggc (SEQ ID NO: 4734), AGAguaacuu (SEQ ID NO: 4735), ACGguagguc (SEQ ID NO: 4736), CAGgcccaga (SEQ ID NO: 4737), CCGgugggu (SEQ ID NO: 4738), AAGgugacgg (SEQ ID NO: 4739), GGGguacagc (SEQ ID NO: 4740), CAUguaaguc (SEQ ID NO: 4741), AUUgugagaa (SEQ ID NO: 4742), UGUguaagga (SEQ ID NO: 4743), UUUguaagau (SEQ ID NO: 4744), AGGgucauuu (SEQ ID NO: 4745), UGGguuuguu (SEQ ID NO: 4746), CGAguaagcc (SEQ ID NO: 4747), GUGgugugua (SEQ ID NO: 4748), AUGguauaac (SEQ ID NO: 4749), UGGguacgua (SEQ ID NO: 4750), AAAguagagu (SEQ ID NO: 4751), UCGguaacug (SEQ ID NO: 4752), AGAguaauga (SEQ ID NO: 4753), AUGgugggucc (SEQ ID NO: 4754), AGAguaauau (SEQ ID NO: 4755), CAGguacugg (SEQ ID NO: 4756), UAAgucaguu (SEQ ID NO: 4757), GCGguagaga (SEQ ID NO: 4758), AAGgugaugg (SEQ ID NO: 4759), ACAguauguu (SEQ ID NO: 4760), GAUguacguc (SEQ ID NO: 4761), UAGguuucuc (SEQ ID NO: 4762), GAGgcauggg (SEQ ID NO: 4763), AUAgcuaagu (SEQ ID NO: 4764), GUAgucugua (SEQ ID NO: 4765), AAGgugaacg (SEQ ID NO: 4766), GUGgugggucg (SEQ ID NO: 4767), GAGguugauc (SEQ ID NO: 4768), UGAgugggguu (SEQ ID NO: 4769), ACUguacgug (SEQ ID NO: 4770), CUGgugacug (SEQ ID NO: 4771), CAAguuaagc (SEQ ID NO: 4772), GAGguaccca (SEQ ID NO: 4773), AACguaacuu (SEQ ID NO: 4774), CAGguuacua (SEQ ID NO: 4775), AGAguuaguc (SEQ ID NO: 4776), UGGgcacguc (SEQ ID NO: 4777), AGUguauggu (SEQ ID NO: 4778), AAGguugcaa (SEQ ID NO: 4779), CAGguuguua (SEQ ID NO: 4780), AAGgcauccc (SEQ ID NO: 4781), GAUguaaggc (SEQ ID NO: 4782), AGGguacggg (SEQ ID NO: 4783), GAGgucaaag (SEQ ID NO: 4784), CAAgugagcg (SEQ ID NO: 4785), AGAguaaucu (SEQ ID NO: 4786), UCGguagcug (SEQ ID NO: 4787), AAAguaguag (SEQ ID NO: 4788), CAGguucguc (SEQ ID NO: 4789), CGUguaugaa (SEQ ID NO: 4790), AGUguaaaaa (SEQ ID NO: 4791), AAGgucucac (SEQ ID NO: 4792), UAGguggagc (SEQ ID NO: 4793), UGAguaggug (SEQ ID NO: 4794), AGAguaugcc (SEQ ID NO: 4795), GAGguugcau (SEQ ID NO: 4796), CAAguaagag (SEQ ID NO: 4797), UCUgugugcc (SEQ ID NO: 4798), GAGgugaugc (SEQ ID NO: 4799), GGGgugauaa (SEQ ID NO: 4800), CCCgugagcc (SEQ ID NO: 4801), AGAguaacug (SEQ ID NO: 4802), GCGguaagua (SEQ ID NO: 4803), AGAguacauc (SEQ ID NO: 4804), UCGgucuggg (SEQ ID NO: 4805), UAAguaucuc (SEQ ID NO: 4806), GGCguagguu (SEQ ID NO: 4807), AGAguacgcc (SEQ ID NO: 4808), GAUgucuucu (SEQ ID NO: 4809), AGGgcaaggu (SEQ ID NO: 4810), CGAguaugau (SEQ ID NO: 4811), AUGguagagu (SEQ ID NO: 4812), CAAguacgag (SEQ ID NO: 4813), UCGguaugau (SEQ ID NO: 4814), CCGguguguu (SEQ ID NO: 4815), AGGgucugug (SEQ ID NO: 4816), GGAguaggcu (SEQ ID NO: 4817), AAGgucuaug (SEQ ID NO: 4818), GCAgugcgug (SEQ ID NO: 4819), UGGgugagaa (SEQ ID NO: 4820), AGGguaaagu (SEQ ID NO: 4821), GAGguaggac (SEQ ID NO: 4822), CUAguaagca (SEQ ID NO: 4823), UUAguaggcu (SEQ ID NO: 4824), CUGgugggau (SEQ ID NO: 4825), CUGguuagua (SEQ ID NO: 4826), AAGguacgug (SEQ ID NO: 4827), CGGgugagau (SEQ ID NO: 4828), AAGgugcaug (SEQ ID NO: 4829), AAUgugggcu (SEQ ID NO: 4830), CAGguugacu (SEQ ID NO: 4831), CAGguuacag (SEQ ID NO: 4832), GCGguaacau (SEQ ID NO: 4833), AUUgucaguc (SEQ ID NO: 4834), CAAguauaca (SEQ ID NO: 4835), GAUguccgcc (SEQ ID NO: 4836), AAGgugcgga (SEQ ID NO: 4837), AACguaagag (SEQ ID NO: 4838), UGGguuggua (SEQ ID NO: 4839), CAAguguaag (SEQ ID NO: 4840), GUGguaacgu (SEQ ID NO: 4841), CUGgugauca (SEQ ID NO: 4842), AGGgugggggc (SEQ ID NO: 4843), UCGguaaaga (SEQ ID NO: 4844), CAGguacacc (SEQ ID NO: 4845), CGGguaaggg (SEQ ID NO: 4846), CAAguuugcu (SEQ ID NO: 4847), ACAgugcgug (SEQ ID NO: 4848), UUGguauggg (SEQ ID NO: 4849), GAGgcucauc (SEQ ID NO: 4850), CUGguaauag (SEQ ID NO: 4851), AUGguggaua (SEQ ID NO: 4852), UCAgugaauu (SEQ ID NO: 4853), AAUguaauua (SEQ ID NO: 4854), GCAgucuaaa (SEQ ID NO: 4855), AAGguauucu (SEQ ID NO: 4856), GAGgucauca (SEQ ID NO: 4857), UGGguccaug (SEQ ID NO: 4858), AGAguuugua (SEQ ID NO: 4859), AGGguagacu (SEQ ID NO: 4860), AAGguaggac (SEQ ID NO: 4861), UGUguguuga (SEQ ID NO: 4862), UCAguacgug (SEQ ID NO: 4863), AUGgucucuc (SEQ ID NO: 4864), UGAguuagua (SEQ ID NO: 4865), UGAguaaagu (SEQ ID NO: 4866), GAGgugaccg (SEQ ID NO: 4867), GAGguauauc (SEQ ID NO: 4868), CAGgugccau (SEQ ID NO: 4869), AGAgugguga (SEQ ID NO: 4870), GUUguaagaa (SEQ ID NO: 4871), AGAguaaaua (SEQ ID NO: 4872), AGGgugaagg (SEQ ID NO: 4873), CUGguagauu (SEQ ID NO: 4874), GAGguucagg (SEQ ID NO: 4875), AGGgucuuca (SEQ ID NO: 4876), CUGguaaccu (SEQ ID NO: 4877), ACAguacuga (SEQ ID NO: 4878), AGAgugggguc (SEQ ID NO: 4879), AUGguaugag (SEQ ID NO: 4880), AAGguuauau (SEQ ID NO: 4881), AGAguauagu (SEQ ID NO: 4882), AAAguaugaa (SEQ ID NO: 4883), UAGguggcua (SEQ ID NO: 4884), ACCguauggg (SEQ ID NO: 4885), AAAguauaau (SEQ ID NO: 4886), UUUguauggc (SEQ ID NO: 4887), GGGgucgcgu (SEQ ID NO: 4888), GUGgugguuu (SEQ ID NO: 4889), CAGguuugac (SEQ ID NO: 4890), GGAguaggcg (SEQ ID NO: 4891), GAGguacccu (SEQ ID NO: 4892), AUGgugugca (SEQ ID NO: 4893), GUGguuggug (SEQ ID NO: 4894), AAAguaugcu (SEQ ID NO: 4895), UAAguuacau (SEQ ID NO: 4896), ACAguaugag (SEQ ID NO: 4897), GGAguauguu (SEQ ID NO: 4898), UUUgugagaa (SEQ ID NO: 4899), AAUgugcguu (SEQ ID NO: 4900), CAGguagagu (SEQ ID NO: 4901), AUGguguuaa (SEQ ID NO: 4902), CAUgugcguc (SEQ ID NO: 4903), AUAguuggau (SEQ ID NO: 4904), GAGguacgua (SEQ ID NO: 4905), GUUgugagaa (SEQ ID NO: 4906), CAAguacauc (SEQ ID NO: 4907), GAGguaguuu (SEQ ID NO: 4908), ACUguacaga (SEQ ID NO: 4909), CCGguuguga (SEQ ID NO: 4910), UGGgucagug (SEQ ID NO: 4911), GUAguaagaa (SEQ ID NO: 4912), GACguacuuu (SEQ ID NO: 4913), AGAgucaguc (SEQ ID NO: 4914), UAGguuaguu (SEQ ID NO: 4915), AGGgcagcag (SEQ ID NO: 4916), AAGguccuac (SEQ ID NO: 4917), AAUguaauug (SEQ ID NO: 4918), CAGgugcggg (SEQ ID NO: 4919), CUGguaaugg (SEQ ID NO: 4920), CAAguagccc (SEQ ID NO: 4921), GAAgucaguu (SEQ ID NO: 4922), ACAguaauug (SEQ ID NO: 4923), UUAguuagua (SEQ ID NO: 4924), CCUguauuuu (SEQ ID NO: 4925), AUCguaagaa (SEQ ID NO: 4926), CCAgugagca (SEQ ID NO: 4927), GAAguaaggc (SEQ ID NO: 4928), UGAgugggua (SEQ ID NO: 4929), UCAgugguag (SEQ ID NO: 4930), UCUguacagg (SEQ ID NO: 4931), CGAgugagug (SEQ ID NO: 4932), UCCguaugug (SEQ ID NO: 4933), CAUgccguuu (SEQ ID NO: 4934), AAAgugacuu (SEQ ID NO: 4935), AGAguaggca (SEQ ID NO: 4936), GAAguaagag (SEQ ID NO: 4937), CAGgcagguu (SEQ ID NO: 4938), UUGguagagc (SEQ ID NO: 4939), AAGguggaaa (SEQ ID NO: 4940), GAGgcagguc (SEQ ID NO: 4941), AUGguacgac (SEQ ID NO: 4942), AGGguaggaa (SEQ ID NO: 4943), AGGguaggua (SEQ ID NO: 4944), UUGguaaggu (SEQ ID NO: 4945), AUGguacaga (SEQ ID NO: 4946), CAGguagagc (SEQ ID NO: 4947), UAGguaaggu (SEQ ID NO: 4948), GGGguuagag (SEQ ID NO: 4949), AAGguaucaa (SEQ ID NO: 4950), GAGguagccc (SEQ ID NO: 4951), CAGgugccuc (SEQ ID NO: 4952), GCAguaagag (SEQ ID NO: 4953), ACGguagagu (SEQ ID NO: 4954), UGGguaaugg (SEQ ID NO: 4955), CUGgucaguu (SEQ ID NO: 4956), GUGguacauu (SEQ ID NO: 4957), AAAguagguu (SEQ ID NO: 4958), AAGgccaaga (SEQ ID NO: 4959), CGGgugggca (SEQ ID NO: 4960), ACGguccggg (SEQ ID NO: 4961), CGAguaugag (SEQ ID NO: 4962), CUGguaugcc (SEQ ID NO: 4963), GAGguggaug (SEQ ID NO: 4964), CAGgccuuuc (SEQ ID NO: 4965), AAAguacauc (SEQ ID NO: 4966), AAAguaauca (SEQ ID NO: 4967), GAGguaacug (SEQ ID NO: 4968), CUGguaaaga (SEQ ID NO: 4969), CGUguaagca (SEQ ID NO: 4970), UGGgcaagua (SEQ ID NO: 4971), GCGguggcga (SEQ ID NO: 4972), GAGguggccg (SEQ ID NO: 4973), AUUgcaugca (SEQ ID NO: 4974), ACGgugacug (SEQ ID NO: 4975), CAGgucagau (SEQ ID NO: 4976), AGAguaacuc (SEQ ID NO: 4977), UGAguaacag (SEQ ID NO: 4978), AAGguacccg (SEQ ID NO: 4979), AGGguaggcu (SEQ ID NO: 4980), GGGgcaggac (SEQ ID NO: 4981), CCUguaagug (SEQ ID NO: 4982), AUUguaagug (SEQ ID NO: 4983), ACUguacgag (SEQ ID NO: 4984), GUAguagugu (SEQ ID NO: 4985), AGAguaugag (SEQ ID NO: 4986), UCAguguggg (SEQ ID NO: 4987), UGGguauaua (SEQ ID NO: 4988), UAGguagcua (SEQ ID NO: 4989), GGGguaaaga (SEQ ID NO: 4990), AGGguuacuu (SEQ ID NO: 4991), CAUguaaaug (SEQ ID NO: 4992), GGAguaguaa (SEQ ID NO: 4993), CAGgucaauc (SEQ ID NO: 4994), CGGguuagug (SEQ ID NO: 4995), UAGguacaug (SEQ ID NO: 4996), UAGguuaaga (SEQ ID NO: 4997), UGGguaccuu (SEQ ID NO: 4998), CGGgugguaca (SEQ ID NO: 4999), CAGgucuuac (SEQ ID NO: 5000), AAGguggagc (SEQ ID NO: 5001), AUGguaacca (SEQ ID NO: 5002), UCGguaaguu (SEQ ID NO: 5003), UAUguacaaa (SEQ ID NO: 5004), AAUguagauu (SEQ ID NO: 5005), GUAgcuagua (SEQ ID NO: 5006), AAGguauugg (SEQ ID NO: 5007), GAGgucuuug (SEQ ID NO: 5008), GAAguucagg (SEQ ID NO: 5009), UGGguaucac (SEQ ID NO: 5010), AGAguacugg (SEQ ID NO: 5011), CAGguuaaug (SEQ ID NO: 5012), AGGguacgug (SEQ ID NO: 5013), AGGgcacagg (SEQ ID NO: 5014), CUGguuaguu (SEQ ID NO: 5015), UUGguacgag (SEQ ID NO: 5016), ACGgugauca (SEQ ID NO: 5017), CCUgugagag (SEQ ID NO: 5018), GAGgugaagu (SEQ ID NO: 5019), AAGguacauc (SEQ ID NO: 5020), UCUguaugug (SEQ ID NO: 5021), UUGguggaag (SEQ ID NO: 5022), UGGgcagguu (SEQ ID NO: 5023), GAAguggagc (SEQ ID NO: 5024), ACAguaagac (SEQ ID NO: 5025), CGGguaccaa (SEQ ID NO: 5026), CAAguacguc (SEQ ID NO: 5027), AGAgugaggg (SEQ ID NO: 5028), CGGguaagaa (SEQ ID NO: 5029), AAUguaggug (SEQ ID NO: 5030), AUCgugugcu (SEQ ID NO: 5031), UAGgucaugg (SEQ ID NO: 5032), CAGguuuuga (SEQ ID NO: 5033), AAGgcaugca (SEQ ID NO: 5034), GAGgugcugc (SEQ ID NO: 5035), AAGguuaaua (SEQ ID NO: 5036), CAGguucauc (SEQ ID NO: 5037), GCGguaggug (SEQ ID NO: 5038), GACguggagua (SEQ ID NO: 5039), CAGgucuacu (SEQ ID NO: 5040), UUGguaugag (SEQ ID NO: 5041), AGCgugggca (SEQ ID NO: 5042), AUGguaaggu (SEQ ID NO: 5043), AUGguaccuc (SEQ ID NO: 5044), UUGguauggu (SEQ ID NO: 5045), UAUguaugaa (SEQ ID NO: 5046), UGGguauggg (SEQ ID NO: 5047), GAUguaaaua (SEQ ID NO: 5048), CCGguaaguu (SEQ ID NO: 5049), GAGgucugaa (SEQ ID NO: 5050), GAGgugcgag (SEQ ID NO: 5051), CUGgucagcc (SEQ ID NO: 5052), CAGguuuugu (SEQ ID NO: 5053), CGGgugguguu (SEQ ID NO: 5054), UAAguuagua (SEQ ID NO: 5055), UUUgugugug (SEQ ID NO: 5056), CAGguuaacc (SEQ ID NO: 5057), UUGguacuuu (SEQ ID NO: 5058), GCUguaaggc (SEQ ID NO: 5059), AGGguggcug (SEQ ID NO: 5060), GAUguaaaaa (SEQ ID NO: 5061), AAGgucaaaa (SEQ ID NO: 5062), CAGguagcgc (SEQ ID NO: 5063), CAGguuuggc (SEQ ID NO: 5064), GAGgugguuu (SEQ ID NO: 5065), CGGguaaaua (SEQ ID NO: 5066), CUGguucggu (SEQ ID NO: 5067), GGAgugagcc (SEQ ID NO: 5068), AAGgugcgcg (SEQ ID NO: 5069), GAAguacauc (SEQ ID NO: 5070), AGUgucugua (SEQ ID NO: 5071), CCCgugagcu (SEQ ID NO: 5072), GAGguucaca (SEQ ID NO: 5073), CUAgugggua (SEQ ID NO: 5074), GAGguaacua (SEQ ID NO: 5075), UCGguauguc (SEQ ID NO: 5076), UAAguauuug (SEQ ID NO: 5077), CAGguaagcg (SEQ ID NO: 5078), GAGgugguaa (SEQ ID NO: 5079), CGAguaagag (SEQ ID NO: 5080), CCGguaagcu (SEQ ID NO: 5081), GAGgucuugu (SEQ ID NO: 5082), AAGgugggguc (SEQ ID NO: 5083), CACguaagug (SEQ ID NO: 5084), AGUguaauga (SEQ ID NO: 5085), AAAgugugua (SEQ ID NO: 5086), GGAgugccaa (SEQ ID NO: 5087), CACgugaguu (SEQ ID NO: 5088), AAGguuggau (SEQ ID NO: 5089), UAUguaaaua (SEQ ID NO: 5090), CUGguaggaa (SEQ ID NO: 5091), UAUguaaacu (SEQ ID NO: 5092), AAUguauuuu (SEQ ID NO: 5093), CUGgcaagug (SEQ ID NO: 5094), UGUgugguau (SEQ ID NO: 5095), UAUguauguu (SEQ ID NO: 5096), UUGgugacuc (SEQ ID NO: 5097), GGAguaaggu (SEQ ID NO: 5098), AAGguagaug (SEQ ID NO: 5099), UGGguagggu (SEQ ID NO: 5100), AAUguaauuc (SEQ ID NO: 5101), GUGguauggc (SEQ ID NO: 5102), GGAgugggguu (SEQ ID NO: 5103), AGGguaccac (SEQ ID NO: 5104), UAGgugacag (SEQ ID NO: 5105), ACAguaggca (SEQ ID NO: 5106), AUGguuugaa (SEQ ID NO: 5107), GCAguaacua (SEQ ID NO: 5108), CCGguaggua (SEQ ID NO: 5109), AGAguaggcc (SEQ ID NO: 5110), AAGguugaca (SEQ ID NO: 5111), CUGgugugua (SEQ ID NO: 5112), GAAgucuguc (SEQ ID NO: 5113), UGGgcucgga (SEQ ID NO: 5114), CAGguagccu (SEQ ID NO: 5115), AGAguaggua (SEQ ID NO: 5116), UAAguauguc (SEQ ID NO: 5117), CUGguauauc (SEQ ID NO: 5118), GAGguguguu (SEQ ID NO: 5119), AUGgugcaug (SEQ ID NO: 5120), AAGguacgcc (SEQ ID NO: 5121), UGAguaacua (SEQ ID NO: 5122), GAGgugacag (SEQ ID NO: 5123), GUUguccugu (SEQ ID NO: 5124), UUGgugucuu (SEQ ID NO: 5125), AAUgugaagg (SEQ ID NO: 5126), UUGguggaua (SEQ ID NO: 5127), UAGguguguu (SEQ ID NO: 5128), CUGgcaaguu (SEQ ID NO: 5129), GCAguaagau (SEQ ID NO: 5130), GCGguggaaa (SEQ ID NO: 5131), UGCguccagc (SEQ ID NO: 5132), AAAguggagu (SEQ ID NO: 5133), CGUgugagcc (SEQ ID NO: 5134), AGAguacugu (SEQ ID NO: 5135), CAGguauagc (SEQ ID NO: 5136), UACguaagga (SEQ ID NO: 5137), AAGgucuuua (SEQ ID NO: 5138), AAGgugugucu (SEQ ID NO: 5139), GGGguaaauu (SEQ ID NO: 5140), UCAgugagga (SEQ ID NO: 5141), AGAguacguu (SEQ ID NO: 5142), GAGgucguca (SEQ ID NO: 5143), UAGguuugau (SEQ ID NO: 5144), CAUguaaacc (SEQ ID NO: 5145), AAGguggcac (SEQ ID NO: 5146), CAGguagaug (SEQ ID NO: 5147), AACguaaaag (SEQ ID NO: 5148), UAGgucucug (SEQ ID NO: 5149), AUAguaggug (SEQ ID NO: 5150), UAGgcaagag (SEQ ID NO: 5151), UAGgcacggc (SEQ ID NO: 5152), AAGgucuuca (SEQ ID NO: 5153), CCAguaugcu (SEQ ID NO: 5154), CAAgugaguu (SEQ ID NO: 5155), CAGgucucaa (SEQ ID NO: 5156), CAGguuacau (SEQ ID NO: 5157), GGAgugagca (SEQ ID NO: 5158), AGAguacgca (SEQ ID NO: 5159), CUGguguugg (SEQ ID NO: 5160), AAGguacuca (SEQ ID NO: 5161), CUAguaaggg (SEQ ID NO: 5162), AGAguaaaag (SEQ ID NO: 5163), AAGguaacga (SEQ ID NO: 5164), CUGguccccg (SEQ ID NO: 5165), UAAguauggg (SEQ ID NO: 5166), GAGgucgagc (SEQ ID NO: 5167), UUGguauaua (SEQ ID NO: 5168), AAAgucaagg (SEQ ID NO: 5169), AAGgucuagg (SEQ ID NO: 5170), CGAguagguc (SEQ ID NO: 5171), AGGguucguu (SEQ ID NO: 5172), GAGgcaggcc (SEQ ID NO: 5173), CUAguauuac (SEQ ID NO: 5174), ACGguaugug (SEQ ID NO: 5175), UAGgugguuc (SEQ ID NO: 5176), AGAguauaac (SEQ ID NO: 5177), UUGgugcguc (SEQ ID NO: 5178), ACCguuaucu (SEQ ID NO: 5179), CCAgugauga (SEQ ID NO: 5180), GAAguaugca (SEQ ID NO: 5181), GAAguauggc (SEQ ID NO: 5182), CCGguaggac (SEQ ID NO: 5183), AAUguaagca (SEQ ID NO: 5184), AGAguaauug (SEQ ID NO: 5185), AGGguugguu (SEQ ID NO: 5186), GUGguaggag (SEQ ID NO: 5187), AAGgcaguuu (SEQ ID NO: 5188), CAAguaagcc (SEQ ID NO: 5189), CUGgcaagua (SEQ ID NO: 5190), CAGgcaugau (SEQ ID NO: 5191), AGGguaauug (SEQ ID NO: 5192), GGGguaaccu (SEQ ID NO: 5193), AAAguaacua (SEQ ID NO: 5194), UAGgucugcc (SEQ ID NO: 5195), ACGguaugaa (SEQ ID NO: 5196), AGUguauggg (SEQ ID NO: 5197), UGGguuggca (SEQ ID NO: 5198), UAGguaaacu (SEQ ID NO: 5199), AGAguggguga (SEQ ID NO: 5200), AGAguauuug (SEQ ID NO: 5201), AGUguaggaa (SEQ ID NO: 5202), CUUguacgua (SEQ ID NO: 5203), GAUgugagau (SEQ ID NO: 5204), CAGgcagcca (SEQ ID NO: 5205), AAGgucacug (SEQ ID NO: 5206), AAGgucugac (SEQ ID NO: 5207), UAGguuccuu (SEQ ID NO: 5208), CUGgugcuuu (SEQ ID NO: 5209), UGAguuggug (SEQ ID NO: 5210), UUGgugggau (SEQ ID NO: 5211), UGAguagggu (SEQ ID NO: 5212), UCGgugaggu (SEQ ID NO: 5213), AAAguaaaga (SEQ ID NO: 5214), AAGgcaaguc (SEQ ID NO: 5215), CGGguaaagc (SEQ ID NO: 5216), AAAguuaguu (SEQ ID NO: 5217), UUAguaagca (SEQ ID NO: 5218), GAGgucacau (SEQ ID NO: 5219), UAAgugguau (SEQ ID NO: 5220), UAGgugcuuu (SEQ ID NO: 5221), GGAguaggca (SEQ ID NO: 5222), UGAguaagga (SEQ ID NO: 5223), CAGguggagc (SEQ ID NO: 5224), GAUguagaag (SEQ ID NO: 5225), AAUgccugcc (SEQ ID NO: 5226), AUGguaaggc (SEQ ID NO: 5227), UGGguaauau (SEQ ID NO: 5228), CUGguaccuc (SEQ ID NO: 5229), CACgugagcc (SEQ ID NO: 5230), UGAguuugug (SEQ ID NO: 5231), CCGguagugu (SEQ ID NO: 5232), AAAgugacaa (SEQ ID NO: 5233), GAAgugg-guu (SEQ ID NO: 5234), CAGgugcagc (SEQ ID NO: 5235), GAGgugggcc (SEQ ID NO: 5236), UAUgugcguc (SEQ ID NO: 5237), GGGguacugg (SEQ ID NO: 5238), CUGguag-guu (SEQ ID NO: 5239), UUGgcauguu (SEQ ID NO: 5240), AAUguaauac (SEQ ID NO: 5241), UAGgccggug (SEQ ID NO: 5242), AGAgucagua (SEQ ID NO: 5243), UAAguaaauc (SEQ ID NO: 5244), CAGguuccuc (SEQ ID NO: 5245), UAGguacgau (SEQ ID NO: 5246), AGAguuagug (SEQ ID NO: 5247), GCAguaagug (SEQ ID NO: 5248), AGGgugguag (SEQ ID NO: 5249), GGAguaaugu (SEQ ID NO: 5250), GAUguaaguc (SEQ ID NO: 5251), CCAguuucgu (SEQ ID NO: 5252), AAG-guucggg (SEQ ID NO: 5253), AUGguggagu (SEQ ID NO: 5254), AAGguaccgg (SEQ ID NO: 5255), GAAgugcgaa (SEQ ID NO: 5256), UGGgucaguu (SEQ ID NO: 5257), AAGguguaga (SEQ ID NO: 5258), UGGguaggcc (SEQ ID NO: 5259), CCAgugaguc (SEQ ID NO: 5260), AAGguca-cuu (SEQ ID NO: 5261), AGCgugaggc (SEQ ID NO: 5262), UCCgugguaa (SEQ ID NO: 5263), AGAguacuua (SEQ ID NO: 5264), GGGgucagau (SEQ ID NO: 5265), AAG-guggacc (SEQ ID NO: 5266), AGAgugagcg (SEQ ID NO: 5267), AGAgucagau (SEQ ID NO: 5268), UAAguauuac (SEQ ID NO: 5269), AGAguauuuc (SEQ ID NO: 5270), AGAguucagc (SEQ ID NO: 5271), AUGgugaagu (SEQ ID NO: 5272), UAGgugaucc (SEQ ID NO: 5273), GGAguaagau (SEQ ID NO: 5274), UAGguaccaa (SEQ ID NO: 5275), AGAguuggucc (SEQ ID NO: 5276), GAAguga-gac (SEQ ID NO: 5277), AUCguagguu (SEQ ID NO: 5278), GAGguacgcu (SEQ ID NO: 5279), ACGguaaggg (SEQ ID NO: 5280), CAGgcauguc (SEQ ID NO: 5281), UUAguaagau (SEQ ID NO: 5282), UGAguagguu (SEQ ID NO: 5283), AGGguacgaa (SEQ ID NO: 5284), ACGguau-guu (SEQ ID NO: 5285), AGGguacugu (SEQ ID NO: 5286), UUGguaugga (SEQ ID NO: 5287), UAAguaacug (SEQ ID NO: 5288), GCGgucagcc (SEQ ID NO: 5289), UUUguga-guc (SEQ ID NO: 5290), GUGgucagug (SEQ ID NO: 5291), CUGgucugua (SEQ ID NO: 5292), GAGguucuua (SEQ ID NO: 5293), AUGguacuga (SEQ ID NO: 5294), AAUgugc-uuu (SEQ ID NO: 5295), AGGguggcgu (SEQ ID NO: 5296), CCGgcaggaa (SEQ ID NO: 5297), CAUgugggucc (SEQ ID NO: 5298), UUGguuuguu (SEQ ID NO: 5299), CAGguucugu (SEQ ID NO: 5300), ACGguaagcg (SEQ ID NO: 5301), CUGgucagua (SEQ ID NO: 5302), UCAguaggcu (SEQ ID NO: 5303), UGAguaggac (SEQ ID NO: 5304), CAGguuuuaa (SEQ ID NO: 5305), GAGgugu-ccc (SEQ ID NO: 5306), AGGgugguu (SEQ ID NO: 5307), GUGgugagac (SEQ ID NO: 5308), CACguaggga (SEQ ID NO: 5309), GUGguauuuu (SEQ ID NO: 5310), GAGauauccu (SEQ ID NO: 5311), AAGgugaaca (SEQ ID NO: 5312), UAAguagggc (SEQ ID NO: 5313), CUG-gugcggg (SEQ ID NO: 5314), CUGgucaaua (SEQ ID NO: 5315), AGAguaaaaa (SEQ ID NO: 5316), AAGgugcagu (SEQ ID NO: 5317), CGGguaagca (SEQ ID NO: 5318), AAAgugagcc (SEQ ID NO: 5319), AUGguaauca (SEQ ID NO: 5320), GCAguacgug (SEQ ID NO: 5321), AUGgua-caug (SEQ ID NO: 5322), AAGguuaaga (SEQ ID NO: 5323), CGGguaaaug (SEQ ID NO: 5324), GAGguucgca (SEQ ID NO: 5325), GAGgcucugg (SEQ ID NO: 5326), AUGgugggac (SEQ ID NO: 5327), AACgugguag (SEQ ID NO: 5328), AAGgugauag (SEQ ID NO: 5329), GGG-guuugca (SEQ ID NO: 5330), CAUguaaggg (SEQ ID NO: 5331), UCAguugagu (SEQ ID NO: 5332), AAAgugcggc (SEQ ID NO: 5333), AGAgugagcc (SEQ ID NO: 5334), AUGgcaagaa (SEQ ID NO: 5335), ACAguaaggu (SEQ ID NO: 5336), AAGgucucua (SEQ ID NO: 5337), GUG-guaaaaa (SEQ ID NO: 5338), AAAguaggug (SEQ ID NO: 5339), UAGgugcacu (SEQ ID NO: 5340), GUCgugguau (SEQ ID NO: 5341), CAGguauagg (SEQ ID NO: 5342), UGAgugagag (SEQ ID NO: 5343), ACUgugagcc (SEQ ID NO: 5344), AUCguuaguu (SEQ ID NO: 5345), UUUguac-caa (SEQ ID NO: 5346), UGGgugagau (SEQ ID NO: 5347), AGAgugagaa (SEQ ID NO: 5348), AGAguagggg (SEQ ID NO: 5349), AGGgcaagua (SEQ ID NO: 5350), CGGguc-agua (SEQ ID NO: 5351), UUGguaugcc (SEQ ID NO: 5352), CGGguuagau (SEQ ID NO: 5353), GGGgugaagu (SEQ ID NO: 5354), CCCgugugaa (SEQ ID NO: 5355), GCAguuugga (SEQ ID NO: 5356), UGCguaagac (SEQ ID NO: 5357), AGAgucugua (SEQ ID NO: 5358), CACgugagca (SEQ ID NO: 5359), AGGguaaaag (SEQ ID NO: 5360), CAGgcugggu (SEQ ID NO: 5361), GAAguc-uuca (SEQ ID NO: 5362), AAGgcaaaaa (SEQ ID NO: 5363), GUAguaaaua (SEQ ID NO: 5364), CUAgugagag (SEQ ID NO: 5365), GAAguuucug (SEQ ID NO: 5366), CCUguacgua (SEQ ID NO: 5367), GAGgugcgcg (SEQ ID NO: 5368), AAGguguaaa (SEQ ID NO: 5369), CCAguau-guu (SEQ ID NO: 5370), CCGgucagcu (SEQ ID NO: 5371), AUGguuccug (SEQ ID NO: 5372), CAAguuaaau (SEQ ID NO: 5373), AGAguaggcu (SEQ ID NO: 5374), AUG-gugggca (SEQ ID NO: 5375), GGAguaagac (SEQ ID NO: 5376), AGGgucacga (SEQ ID NO: 5377), UAGgugauau (SEQ ID NO: 5378), GAAguaaguc (SEQ ID NO: 5379), CGGguaagau (SEQ ID NO: 5380), CAAguagcua (SEQ ID NO: 5381), UGAguaaaau (SEQ ID NO: 5382), GUCguacgug (SEQ ID NO: 5383), AUGguacgua (SEQ ID NO: 5384), CAGgucucgg (SEQ ID NO: 5385), GAGgcau-guc (SEQ ID NO: 5386), AGAgugggau (SEQ ID NO: 5387), GUGguuagag (SEQ ID NO: 5388), UGGgugguga (SEQ ID NO: 5389), AAGguuaaac (SEQ ID NO: 5390), CUU-guuagcu (SEQ ID NO: 5391), AAAguaggaa (SEQ ID NO: 5392), UAGguuguau (SEQ ID NO: 5393), AGGgugcgcc (SEQ ID NO: 5394), AAGgugggcu (SEQ ID NO: 5395), UAAguaucug (SEQ ID NO: 5396), AAGguaacgu (SEQ ID NO: 5397), AUGgugggc (SEQ ID NO: 5398), CAAgua-cacg (SEQ ID NO: 5399), GGCguaagug (SEQ ID NO: 5400), AUAguaggac (SEQ ID NO: 5401), AGAgugaggu (SEQ ID NO: 5402), UUUguaaaaa (SEQ ID NO: 5403), GAAguuugua (SEQ ID NO: 5404), CUAguaaucu (SEQ ID NO: 5405), AAGguuuuua (SEQ ID NO: 5406), GAG-gugcguu (SEQ ID NO: 5407), UAGgcgagua (SEQ ID NO: 5408), ACCgugagua (SEQ ID NO: 5409), CAGgucccga (SEQ ID NO: 5410), AUGguacugg (SEQ ID NO: 5411), UGAguucagu (SEQ ID NO: 5412), AAUguguggu (SEQ ID NO: 5413), UCCguugguu (SEQ ID NO: 5414), CAGgu-cagag (SEQ ID NO: 5415), CAGgucccua (SEQ ID NO: 5416), UAGguagacu (SEQ ID NO: 5417), CAAguuaagg (SEQ ID NO: 5418), GAGgugugcg (SEQ ID NO: 5419), GAAgcugccc (SEQ ID NO: 5420), CGAguacgug (SEQ ID NO: 5421), CGGguaggua (SEQ ID NO: 5422), UUG-guauuga (SEQ ID NO: 5423), AUUguaugau (SEQ ID NO: 5424), UUGguaugaa (SEQ ID NO: 5425), GAGgugguca (SEQ ID NO: 5426), GCUguaugaa (SEQ ID NO: 5427), CAGguguugc (SEQ ID NO: 5428), CAGguaaaac (SEQ ID NO: 5429), AUAguaaggu (SEQ ID NO: 5430), CUGguua-gag (SEQ ID NO: 5431), AGCgugugag (SEQ ID NO: 5432), AAGguuaucu (SEQ ID NO: 5433), CACgugagua (SEQ ID NO: 5434), AGGgucagua (SEQ ID NO: 5435), GAG-guauaau (SEQ ID NO: 5436), CAGguuauuu (SEQ ID NO: 5437), AGGguggacu (SEQ ID NO: 5438), AUUguaauuc (SEQ ID NO: 5439), UUUgugggguu (SEQ ID NO: 5440), AUGguacgug (SEQ ID NO: 5441), AAGguguucc (SEQ ID NO: 5442), CAGgugacgc (SEQ ID NO: 5443), GAGguac-uaa (SEQ ID NO: 5444), ACAguucagu (SEQ ID NO: 5445), GAGgucacgg (SEQ ID NO: 5446), CAAguaaggc (SEQ ID NO: 5447), AAGguuuggg (SEQ ID NO: 5448), AAAgugggcu (SEQ ID NO: 5449), GCGguucuug (SEQ ID NO: 5450), GAGguggagc (SEQ ID NO: 5451), UGAgucagug (SEQ ID NO: 5452), CAGgucaagg (SEQ ID NO: 5453), AGUguaagcu (SEQ ID NO: 5454), GAGgcagaaa (SEQ ID NO: 5455), AAGgucacac (SEQ ID NO: 5456), GAAguagguu (SEQ ID NO: 5457), GUCguaaguu (SEQ ID NO: 5458), AGAguaugca (SEQ ID NO: 5459), CCUgugcaaa (SEQ ID NO: 5460), ACGgugaaaa (SEQ ID NO: 5461), CAGguacgaa (SEQ ID NO: 5462), CAUgugagga (SEQ ID NO: 5463), AGCgugagua (SEQ ID NO: 5464), GGUguguagg (SEQ ID NO: 5465), AACgugagcu (SEQ ID NO: 5466), GAGgugaacu (SEQ ID NO: 5467), AGAguucagu (SEQ ID NO: 5468), AACgugugua (SEQ ID NO: 5469), CAGguuugugg (SEQ ID NO: 5470), AAGguacuag (SEQ ID NO: 5471), UCAgugaaaa (SEQ ID NO: 5472), AAUgucuggu (SEQ ID NO: 5473), ACGguaaaau (SEQ ID NO: 5474), CUGguguaag (SEQ ID NO: 5475), GAGgugcgaa (SEQ ID NO: 5476), AGGguuucuc (SEQ ID NO: 5477), CAGguagccc (SEQ ID NO: 5478), AUUguauugg (SEQ ID NO: 5479), AUGguacuua (SEQ ID NO: 5480), GAGgcccgac (SEQ ID NO: 5481), UCGguaagac (SEQ ID NO: 5482), CGGgcuguag (SEQ ID NO: 5483), UAUgugugug (SEQ ID NO: 5484), UAGguagaaa (SEQ ID NO: 5485), GUGgucauua (SEQ ID NO: 5486), UAGgugaaag (SEQ ID NO: 5487), ACUguaauuc (SEQ ID NO: 5488), GCAguacagg (SEQ ID NO: 5489), UCGgugaguc (SEQ ID NO: 5490), UAUguaggga (SEQ ID NO: 5491), AUGguauguc (SEQ ID NO: 5492), GUGgugugug (SEQ ID NO: 5493), CUGgugaccu (SEQ ID NO: 5494), AAUgugaaua (SEQ ID NO: 5495), UAGgucucac (SEQ ID NO: 5496), GAGguuauug (SEQ ID NO: 5497), UGAguaggcu (SEQ ID NO: 5498), CGGgcacgua (SEQ ID NO: 5499), GCAguaaaua (SEQ ID NO: 5500), CCGgugagag (SEQ ID NO: 5501), UAAguugguc (SEQ ID NO: 5502), CCGgugagcc (SEQ ID NO: 5503), AAGguuguca (SEQ ID NO: 5504), CUGguauuau (SEQ ID NO: 5505), GGGguauggg (SEQ ID NO: 5506), AAAgucagua (SEQ ID NO: 5507), UUUguaugua (SEQ ID NO: 5508), UAAguacugc (SEQ ID NO: 5509), CAGguaccaa (SEQ ID NO: 5510), GAAguucaga (SEQ ID NO: 5511), AUGgugcggu (SEQ ID NO: 5512), GUGgugaggu (SEQ ID NO: 5513), UGAguaagcc (SEQ ID NO: 5514), UAUguaaggg (SEQ ID NO: 5515), GUGgugggaaa (SEQ ID NO: 5516), GAGgugauug (SEQ ID NO: 5517), GGAguuugua (SEQ ID NO: 5518), AAGgucacga (SEQ ID NO: 5519), GUGguagagg (SEQ ID NO: 5520), UAAguauauc (SEQ ID NO: 5521), AAGgugucca (SEQ ID NO: 5522), UAUgugguau (SEQ ID NO: 5523), GAGguacaau (SEQ ID NO: 5524), AAGguggggg (SEQ ID NO: 5525), GGAguaggug (SEQ ID NO: 5526), and UAGgugacuu (SEQ ID NO: 5527).

In some embodiments, the splice site sequence (e.g., 5' splice site sequence) comprises AGA. In some embodiments, the splice site sequence (e.g., 5' splice site sequence) comprises AAA. In some embodiments, the splice site sequence (e.g., 5' splice site sequence) comprises AAC. In some embodiments, the splice site sequence (e.g., 5' splice site sequence) comprises AAU. In some embodiments, the splice site sequence (e.g., 5' splice site sequence) comprises AAG. In some embodiments, the splice site sequence (e.g., 5' splice site sequence) comprises ACA. In some embodiments, the splice site sequence (e.g., 5' splice site sequence) comprises AUA. In some embodiments, the splice site sequence (e.g., 5' splice site sequence) comprises AUU. In some embodiments, the splice site sequence (e.g., 5' splice site sequence) comprises AUG. In some embodiments, the splice site sequence (e.g., 5' splice site sequence) comprises AUC. In some embodiments, the splice site sequence (e.g., 5' splice site sequence) comprises CAA. In some embodiments, the splice site sequence (e.g., 5' splice site sequence) comprises CAU. In some embodiments, the splice site sequence (e.g., 5' splice site sequence) comprises CAC. In some embodiments, the splice site sequence (e.g., 5' splice site sequence) comprises CAG. In some embodiments, the splice site sequence (e.g., 5' splice site sequence) comprises GAA. In some embodiments, the splice site sequence (e.g., 5' splice site sequence) comprises GAC. In some embodiments, the splice site sequence (e.g., 5' splice site sequence) comprises GAU. In some embodiments, the splice site sequence (e.g., 5' splice site sequence) comprises GAG. In some embodiments, the splice site sequence (e.g., 5' splice site sequence) comprises GGA. In some embodiments, the splice site sequence (e.g., 5' splice site sequence) comprises GCA. In some embodiments, the splice site sequence (e.g., 5' splice site sequence) comprises GGG. In some embodiments, the splice site sequence (e.g., 5' splice site sequence) comprises GGC. In some embodiments, the splice site sequence (e.g., 5' splice site sequence) comprises GUU. In some embodiments, the splice site sequence (e.g., 5' splice site sequence) comprises GGU. In some embodiments, the splice site sequence (e.g., 5' splice site sequence) comprises GUC. In some embodiments, the splice site sequence (e.g., 5' splice site sequence) comprises GUA. In some embodiments, the splice site sequence (e.g., 5' splice site sequence) comprises GUG. In some embodiments, the splice site sequence (e.g., 5' splice site sequence) comprises UCU. In some embodiments, the splice site sequence (e.g., 5' splice site sequence) comprises UCC. In some embodiments, the splice site sequence (e.g., 5' splice site sequence) comprises UCA. In some embodiments, the splice site sequence (e.g., 5' splice site sequence) comprises UCG. In some embodiments, the splice site sequence (e.g., 5' splice site sequence) comprises UUU. In some embodiments, the splice site sequence (e.g., 5' splice site sequence) comprises UUC. In some embodiments, the splice site sequence (e.g., 5' splice site sequence) comprises UUA. In some embodiments, the splice site sequence (e.g., 5' splice site sequence) comprises UUG. In some embodiments, the splice site sequence (e.g., 5' splice site sequence) comprises UGU. In some embodiments, the splice site sequence (e.g., 5' splice site sequence) comprises UAU. In some embodiments, the splice site sequence (e.g., 5' splice site sequence) comprises GGA. In some embodiments, the splice site sequence (e.g., 5' splice site sequence) comprises CUU. In some embodiments, the splice site sequence (e.g., 5' splice site sequence) comprises CUC. In some embodiments, the splice site sequence (e.g., 5' splice site sequence) comprises CUA. In some embodiments, the splice site sequence (e.g., 5' splice site sequence) comprises CUG. In some embodiments, the splice site sequence (e.g., 5' splice site sequence) comprises CCU. In some embodiments, the splice site sequence (e.g., 5' splice site sequence) comprises CCC. In some embodiments, the splice site sequence (e.g., 5' splice site sequence) comprises CCA. In some embodiments, the splice site sequence (e.g., 5' splice site sequence) comprises CCG. In some embodiments, the splice site sequence (e.g., 5' splice site sequence) comprises ACU. In some embodiments, the splice site sequence (e.g., 5' splice site sequence) comprises ACC. In some embodiments, the splice site sequence (e.g., 5' splice site sequence) comprises ACG. In some embodiments, the splice site sequence (e.g., 5' splice site sequence) comprises AGC. In some embodiments, the splice site sequence (e.g., 5' splice site sequence) comprises AGU. In some embodiments, the splice site sequence (e.g., 5' splice site sequence)

comprises AGG. In some embodiments, the splice site sequence (e.g., 5' splice site sequence) comprises CGU. In some embodiments, the splice site sequence (e.g., 5' splice site sequence) comprises UAC. In some embodiments, the splice site sequence (e.g., 5' splice site sequence) comprises UAA. In some embodiments, the splice site sequence (e.g., 5' splice site sequence) comprises UAG. In some embodiments, the splice site sequence (e.g., 5' splice site sequence) comprises CGC. In some embodiments, the splice site sequence (e.g., 5' splice site sequence) comprises CGA. In some embodiments, the splice site sequence (e.g., 5' splice site sequence) comprises CGG. In some embodiments, the splice site sequence comprises AGAguaaggg (SEQ ID NO: 667).

In an embodiment, a gene sequence or splice site sequence provided herein is related to a proliferative disease, disorder, or condition (e.g., cancer, benign neoplasm, or inflammatory disease). In an embodiment, a gene sequence or splice site sequence provided herein is related to a non-proliferative disease, disorder, or condition. In an embodiment, a gene sequence or splice site sequence provided herein is related to a neurological disease or disorder; autoimmune disease or disorder; immunodeficiency disease or disorder; lysosomal storage disease or disorder; cardiovascular condition, disease or disorder; metabolic disease or disorder; respiratory condition, disease, or disorder; renal disease or disorder; or infectious disease in a subject. In an embodiment, a gene sequence or splice site sequence provided herein is related to a neurological disease or disorder (e.g., Huntington's disease). In an embodiment, a gene sequence or splice site sequence provided herein is related to an immunodeficiency disease or disorder. In an embodiment, a gene sequence or splice site sequence provided herein is related to a lysosomal storage disease or disorder. In an embodiment, a gene sequence or splice site sequence provided herein is related to a cardiovascular condition, disease or disorder. In an embodiment, a gene sequence or splice site sequence provided herein is related to a metabolic disease or disorder. In an embodiment, a gene sequence or splice site sequence provided herein is related to a respiratory condition, disease, or disorder. In an embodiment, a gene sequence or splice site sequence provided herein is related to a renal disease or disorder. In an embodiment, a gene sequence or splice site sequence provided herein is related to an infectious disease.

In an embodiment, a gene sequence or splice site sequence provided herein is related to a mental retardation disorder. In an embodiment, a gene sequence or splice site sequence provided herein is related to a mutation in the SETD5 gene. In an embodiment, a gene sequence or splice site sequence provided herein is related to an immunodeficiency disorder. In an embodiment, a gene sequence and splice site sequence provided herein is related to a mutation in the GATA2 gene.

In some embodiments, a compound of Formula (I) described herein interacts with (e.g., binds to) a splicing complex component (e.g., a nucleic acid (e.g., an RNA) or a protein). In some embodiments, the splicing complex component is selected from 9G8, A1 hnRNP, A2 hnRNP, ASD-1, ASD-2b, ASF, BRR2, B1 hnRNP, $C_1$ hnRNP, $C_2$ hnRNP, CBP20, CBP80, CELF, F hnRNP, FBP11, Fox-1, Fox-2, G hnRNP, H hnRNP, hnRNP 1, hnRNP 3, hnRNP C, hnRNP G, hnRNP K, hnRNP M, hnRNP U, Hu, HUR, IhnRNP, K hnRNP, KH-type splicing regulatory protein (KSRP), L hnRNP, LUC7L, M hnRNP, mBBP, muscle-blind like (MBNL), NF45, NFAR, Nova-1, Nova-2, nPTB, P54/SFRS11, polypyrimidine tract binding protein (PTB), a PRP protein (e.g., PRP8, PRP6, PRP31, PRP4, PRP3, PRP28, PRP5, PRP2, PRP19), PRP19 complex proteins, RBM42, R hnRNP, RNPC1, SAD1, SAM68, SC35, SF, SF1/BBP, SF2, SF3A complex, SF3B complex, SFRS10, an Sm protein (such as B, D1, D2, D3, F, E, G), SNU17, SNU66, SNU114, an SR protein, SRm300, SRp20, SRp30c, SRP35C, SRP36, SRP38, SRp40, SRp55, SRp75, SRSF, STAR, GSG, SUP-12, TASR-1, TASR-2, TIA, TIAR, TRA2, TRA2a/b, U hnRNP, U1 snRNP, U11 snRNP, U12 snRNP, U1-70K, U1-A, U1-C, U2 snRNP, U2AF1-RS2, U2AF35, U2AF65, U4 snRNP, U5 snRNP, U6 snRNP, Urp, and YB1.

In some embodiments, the splicing complex component comprises RNA (e.g., snRNA). In some embodiments, a compound described herein binds to a splicing complex component comprising snRNA. The snRNA may be selected from, e.g., U1 snRNA, U2 snRNA, U4 snRNA, U5 snRNA, U6 snRNA, U11 snRNA, U12 snRNA, U4atac snRNA, and any combination thereof.

In some embodiments, the splicing complex component comprises a protein, e.g., a protein associated with an snRNA. In some embodiments, the protein comprises SC35, SRp55, SRp40, SRm300, SFRS10, TASR-1, TASR-2, SF2/ASF, 9G8, SRp75, SRp30c, SRp20 and P54/SFRS11. In some embodiments, the splicing complex component comprises a U2 snRNA auxiliary factor (e.g., U2AF65, U2AF35), Urp/U2AF1-RS2, SF1/BBP, CBP80, CBP 20, SF1 or PTB/hnRNPL. In some embodiments, the splicing complex component comprises a heterogenous ribonucleoprotein particle (hnRNP), e.g., an hnRNP protein. In some embodiments, the hnRNP protein comprises A1, A2/B1, L, M, K, U, F, H, G, R, I or $C_1/C_2$. Human genes encoding hnRNPs include HNRNPA0, HNRNPA1, HNRNPA1L1, HNRNPA1L2, HNRNPA3, HNRNPA2B1, HNRNPAB, HNRNPB1, HNRNPC, HNRNPCL1, HNRNPD, HNRPDL, HNRNPF, HNRNPH1, HNRNPH2, HNRNPH3, HNRNPK, HNRNPL, HNRPLL, HNRNPM, HNRNPR, HNRNPU, HNRNPUL1, HNRNPUL2, HNRNPUL3, and FMR1.

In one aspect, the compounds of Formula (I) and pharmaceutically acceptable salts, solvates, hydrates, tautomers, stereoisomers, and compositions thereof, may modulate (e.g., increase or decrease) a splicing event of a target nucleic acid sequence (e.g., DNA, RNA, or a pre-mRNA), for example, a nucleic acid encoding a gene described herein, or a nucleic acid encoding a protein described herein, or a nucleic acid comprising a splice site described herein. In an embodiment, the splicing event is an alternative splicing event.

In an embodiment, the compound of Formula (I) or a pharmaceutically acceptable salt, solvate, hydrate, tautomer, stereoisomer, and compositions thereof increases splicing at splice site on a target nucleic acid (e.g., an RNA, e.g., a pre-mRNA), by about 0.5%, 1%, 2%, 3%, 4%, 5%, 6%, 7%, 8%, 9%, 10%, 15%, 20%, 25%, 30%, 35%, 40%, 45%, 50%, 55%, 60%, 65%, 70%, 75%, 80%, 85%, 90%, 95%, or more, e.g., as determined by a known method in the art, e.g., qPCR. In an embodiment, the compound of Formula (I) or a pharmaceutically acceptable salt, solvate, hydrate, tautomer, stereoisomer, and compositions thereof decreases splicing at splice site on a target nucleic acid (e.g., an RNA, e.g., a pre-mRNA), by about 0.5%, 1%, 2%, 3%, 4%, 5%, 6%, 7%, 8%, 9%, 10%, 15%, 20%, 25%, 30%, 35%, 40%, 45%, 50%, 55%, 60%, 65%, 70%, 75%, 80%, 85%, 90%, 95%, or more, e.g., as determined by a known method in the art, e.g., qPCR.

In another aspect, the present disclosure features a method of forming a complex comprising a component of a spliceosome (e.g., a major spliceosome component or a minor spliceosome component), a nucleic acid (e.g., a DNA, RNA, e.g., a pre-mRNA), and a compound of Formula (I) or a pharmaceutically acceptable salt, solvate, hydrate, tautomer, stereoisomer, or composition thereof, comprising contacting the nucleic acid (e.g., a DNA, RNA, e.g., a pre-mRNA) with said compound of Formula (I). In an embodiment, the component of a spliceosome is selected from the U1, U2, U4, U5, U6, U11, U12, U4atac, U6atac small nuclear ribonucleoproteins (snRNPs), or a related accessory factor. In an embodiment, the component of a spliceosome is recruited to the nucleic acid in the presence of the compound of Formula (I), or a pharmaceutically acceptable salt, solvate, hydrate, tautomer, stereoisomer, or composition thereof.

In another aspect, the present disclosure features a method of altering the conformation of a nucleic acid (e.g., a DNA, RNA, e.g., a pre-mRNA) comprising contacting the nucleic acid with a compound of Formula (I) or a pharmaceutically acceptable salt, solvate, hydrate, tautomer, stereoisomer, or composition thereof. In an embodiment, the altering comprises forming a bulge or kink in the nucleic acid. In an embodiment, the altering comprises stabilizing a bulge or a kink in the nucleic acid. In an embodiment, the altering comprises reducing a bulge or a kink in the nucleic acid. In an embodiment, the nucleic acid comprises a splice site. In an embodiment, the compound of Formula (I) interacts with a nucleobase, ribose, or phosphate moiety of a nucleic acid (e.g., a DNA, RNA, e.g., pre-mRNA).

The present disclosure also provides methods for the treatment or prevention of a disease, disorder, or condition. In an embodiment, the disease, disorder or condition is related to (e.g., caused by) a splicing event, such as an unwanted, aberrant, or alternative splicing event. In an embodiment, the disease, disorder or condition comprises a proliferative disease (e.g., cancer, benign neoplasm, or inflammatory disease) or non-proliferative disease. In an embodiment, the disease, disorder, or condition comprises a neurological disease, autoimmune disorder, immunodeficiency disorder, cardiovascular condition, metabolic disorder, lysosomal storage disease, respiratory condition, renal disease, or infectious disease in a subject. In another embodiment, the disease, disorder, or condition comprises a haploinsufficiency disease, an autosomal recessive disease (e.g., with residual function), or a paralogue activation disorder. In another embodiment, the disease, disorder, or condition comprises an autosomal dominant disorder (e.g., with residual function). Such methods comprise the step of administering to the subject in need thereof an effective amount of a compound of Formula (I), or a pharmaceutically acceptable salt, solvate, hydrate, tautomer, stereoisomer thereof, or a pharmaceutical composition thereof. In certain embodiments, the methods described herein include administering to a subject an effective amount of a compound of Formula (I), or a pharmaceutically acceptable salt thereof, or a pharmaceutical composition thereof.

In certain embodiments, the subject being treated is a mammal. In certain embodiments, the subject is a human. In certain embodiments, the subject is a domesticated animal, such as a dog, cat, cow, pig, horse, sheep, or goat. In certain embodiments, the subject is a companion animal such as a dog or cat. In certain embodiments, the subject is a livestock animal such as a cow, pig, horse, sheep, or goat. In certain embodiments, the subject is a zoo animal. In another embodiment, the subject is a research animal such as a rodent, dog, or non-human primate. In certain embodiments, the subject is a non-human transgenic animal such as a transgenic mouse or transgenic pig.

A proliferative disease, disorder, or condition may also be associated with inhibition of apoptosis of a cell in a biological sample or subject. All types of biological samples described herein or known in the art are contemplated as being within the scope of the disclosure. The compounds of Formula (I) and pharmaceutically acceptable salts, solvates, hydrates, tautomers, stereoisomers, and compositions thereof, may induce apoptosis, and therefore, be useful in treating and/or preventing proliferative diseases, disorders, or conditions.

In certain embodiments, the proliferative disease to be treated or prevented using the compounds of Formula (I) is cancer. As used herein, the term “cancer” refers to a malignant neoplasm (Stedman’s Medical Dictionary, 25th ed.; Hensyl ed.; Williams & Wilkins: Philadelphia, 1990). All types of cancers disclosed herein or known in the art are contemplated as being within the scope of the disclosure. Exemplary cancers include, but are not limited to, acoustic neuroma; adenocarcinoma; adrenal gland cancer; anal cancer; angiosarcoma (e.g., lymphangiosarcoma, lymphangioendotheliosarcoma, hemangiosarcoma); appendix cancer; benign monoclonal gammopathy; biliary cancer (e.g., cholangiocarcinoma); bladder cancer; breast cancer (e.g., adenocarcinoma of the breast, papillary carcinoma of the breast, mammary cancer, medullary carcinoma of the breast); brain cancer (e.g., meningioma, glioblastomas, glioma (e.g., astrocytoma, oligodendroglioma), medulloblastoma); bronchus cancer; carcinoid tumor; cervical cancer (e.g., cervical adenocarcinoma); choriocarcinoma; chordoma; craniopharyngioma; colorectal cancer (e.g., colon cancer, rectal cancer, colorectal adenocarcinoma); connective tissue cancer; epithelial carcinoma; ependymoma; endotheliosarcoma (e.g., Kaposi’s sarcoma, multiple idiopathic hemorrhagic sarcoma); endometrial cancer (e.g., uterine cancer, uterine sarcoma); esophageal cancer (e.g., adenocarcinoma of the esophagus, Barrett’s adenocarcinoma); Ewing’s sarcoma; eye cancer (e.g., intraocular melanoma, retinoblastoma); familiar hypereosinophilia; gall bladder cancer; gastric cancer (e.g., stomach adenocarcinoma); gastrointestinal stromal tumor (GIST); germ cell cancer; head and neck cancer (e.g., head and neck squamous cell carcinoma, oral cancer (e.g., oral squamous cell carcinoma), throat cancer (e.g., laryngeal cancer, pharyngeal cancer, nasopharyngeal cancer, oropharyngeal cancer)); hematopoietic cancers (e.g., leukemia such as acute lymphocytic leukemia (ALL) (e.g., B-cell ALL, T-cell ALL), acute myelocytic leukemia (AML) (e.g., B-cell AML, T-cell AML), chronic myelocytic leukemia (CML) (e.g., B-cell CML, T-cell CML), and chronic lymphocytic leukemia (CLL) (e.g., B-cell CLL, T-cell CLL)); lymphoma such as Hodgkin lymphoma (HL) (e.g., B-cell HL, T-cell HL) and non-Hodgkin lymphoma (NHL) (e.g., B-cell NHL such as diffuse large cell lymphoma (DLCL) (e.g., diffuse large B-cell lymphoma), follicular lymphoma, chronic lymphocytic leukemia/small lymphocytic lymphoma (CLL/SLL), mantle cell lymphoma (MCL), marginal zone B-cell lymphomas (e.g., mucosa-associated lymphoid tissue (MALT) lymphomas, nodal marginal zone B-cell lymphoma, splenic marginal zone B-cell lymphoma), primary mediastinal B-cell lymphoma, Burkitt lymphoma, lymphoplasmacytic lymphoma (i.e., Waldenstrom’s macroglobulinemia), hairy cell leukemia (HCL), immunoblastic large cell lymphoma, precursor B-lymphoblastic lymphoma and primary central nervous system (CNS) lymphoma; and T-cell NHL such as precursor T-lymphoblastic lymphoma/leukemia, peripheral T-cell lymphoma (PTCL) (e.g., cutaneous T-cell lymphoma (CTCL) (e.g., mycosis fungoides, Sezary syndrome), angioimmunoblastic T-cell lymphoma, extranodal natural killer T-cell lymphoma, enteropathy type T-cell lymphoma, subcutaneous panniculitis-like T-cell lymphoma, and anaplastic large cell lymphoma); a mixture of one or more leukemia/lymphoma as described above; and multiple myeloma (MM)), heavy chain disease (e.g., alpha chain disease, gamma chain disease, mu chain disease); hemangioblastoma; hypopharynx cancer; inflammatory myofibroblastic tumors; immunocytic amyloidosis; kidney cancer (e.g., nephroblastoma a.k.a. Wilms' tumor, renal cell carcinoma); liver cancer (e.g., hepatocellular cancer (HCC), malignant hepatoma); lung cancer (e.g., bronchogenic carcinoma, small cell lung cancer (SCLC), non-small cell lung cancer (NSCLC), adenocarcinoma of the lung); leiomyosarcoma (LMS); mastocytosis (e.g., systemic mastocytosis); muscle cancer; myelodysplastic syndrome (MDS); mesothelioma; myeloproliferative disorder (MPD) (e.g., polycythemia vera (PV), essential thrombocytosis (ET), agnogenic myeloid metaplasia (AMM) a.k.a. myelofibrosis (MF), chronic idiopathic myelofibrosis, chronic myelocytic leukemia (CML), chronic neutrophilic leukemia (CNL), hypereosinophilic syndrome (HES)); neuroblastoma; neurofibroma (e.g., neurofibromatosis (NF) type 1 or type 2, schwannomatosis); neuroendocrine cancer (e.g., gastroenteropancreatic neuroendocrine tumor (GEP-NET), carcinoid tumor); osteosarcoma (e.g., bone cancer); ovarian cancer (e.g., cystadenocarcinoma, ovarian embryonal carcinoma, ovarian adenocarcinoma); papillary adenocarcinoma; pancreatic cancer (e.g., pancreatic adenocarcinoma, intraductal papillary mucinous neoplasm (IPMN), Islet cell tumors); penile cancer (e.g., Paget's disease of the penis and scrotum); pinealoma; primitive neuroectodermal tumor (PNT); plasma cell neoplasia; paraneoplastic syndromes; intraepithelial neoplasms; prostate cancer (e.g., prostate adenocarcinoma); rectal cancer; rhabdomyosarcoma; salivary gland cancer; skin cancer (e.g., squamous cell carcinoma (SCC), keratoacanthoma (KA), melanoma, basal cell carcinoma (BCC)); small bowel cancer (e.g., appendix cancer); soft tissue sarcoma (e.g., malignant fibrous histiocytoma (MFH), liposarcoma, malignant peripheral nerve sheath tumor (MPNST), chondrosarcoma, fibrosarcoma, myxosarcoma); sebaceous gland carcinoma; small intestine cancer; sweat gland carcinoma; synovioma; testicular cancer (e.g., seminoma, testicular embryonal carcinoma); thyroid cancer (e.g., papillary carcinoma of the thyroid, papillary thyroid carcinoma (PTC), medullary thyroid cancer); urethral cancer; vaginal cancer; and vulvar cancer (e.g., Paget's disease of the vulva).

In some embodiments, the proliferative disease is associated with a benign neoplasm. For example, a benign neoplasm may include adenoma, fibroma, hemangioma, tuberous sclerosis, and lipoma. All types of benign neoplasms disclosed herein or known in the art are contemplated as being within the scope of the disclosure.

In some embodiments, the proliferative disease is associated with angiogenesis. All types of angiogenesis disclosed herein or known in the art are contemplated as being within the scope of the disclosure.

In some embodiments, the compound of Formula (I), or a pharmaceutically acceptable salt thereof, or compositions comprising such compound or pharmaceutically acceptable salt thereof, is used to prevent or treat a non-proliferative disease. Exemplary non-proliferative diseases include a neurological disease, autoimmune disorder, immunodeficiency disorder, lysosomal storage disease, cardiovascular condition, metabolic disorder, respiratory condition, inflammatory disease, renal disease, or infectious disease.

In certain embodiments, the non-proliferative disease is a neurological disease. In certain embodiments, the compound of Formula (I), or a pharmaceutically acceptable salt thereof, or compositions comprising such compound or pharmaceutically acceptable salt thereof, is used to prevent or treat a neurological disease, disorder, or condition. A neurological disease, disorder, or condition may include a neurodegenerative disease, a psychiatric condition, or a musculoskeletal disease. A neurological disease may further include a repeat expansion disease, e.g., which may be characterized by the expansion of a nucleic acid sequence in the genome. For example, a repeat expansion disease includes myotonic dystrophy, amyotrophic lateral sclerosis, Huntington's disease, a trinucleotide repeat disease, or a polyglutamine disorder (e.g., ataxia, fragile X syndrome). In some embodiments, the neurological disease comprises a repeat expansion disease, e.g., Huntington's disease. Additional neurological diseases, disorders, and conditions include Alzheimer's disease, Huntington's chorea, a prion disease (e.g., Creutzfeld-Jacob disease, bovine spongiform encephalopathy, Kuru, or scrapie), a mental retardation disorder (e.g., a disorder caused by a SETD5 gene mutation, e.g., intellectual disability-facial dysmorphism syndrome, autism spectrum disorder), Lewy Body disease, diffuse Lewy body disease (DLBD), dementia, progressive supranuclear palsy (PSP), progressive bulbar palsy (PBP), psuedobulbar palsy, spinal and bulbar muscular atrophy (SBMA), primary lateral sclerosis, Pick's disease, primary progressive aphasia, corticobasal dementia, Parkinson's disease, Down's syndrome, multiple system atrophy, spinal muscular atrophy (SMA), progressive spinobulbar muscular atrophy (e.g., Kennedy disease), post-polio syndrome (PPS), spinocerebellar ataxia, pantothenate kinase-associated neurodegeneration (PANK), spinal degenerative disease/motor neuron degenerative diseases, upper motor neuron disorder, lower motor neuron disorder, Hallervorden-Spatz syndrome, cerebral infarction, cerebral trauma, chronic traumatic encephalopathy, transient ischemic attack, Lytigo-bodig (amyotrophic lateral sclerosis-parkinsonism dementia), Guam-Parkinsonism dementia, hippocampal sclerosis, corticobasal degeneration, Alexander disease, Apler's disease, Krabbe's disease, neuroborreliosis, neurosyphilis, Sandhoff disease, Tay-Sachs disease, Schilder's disease, Batten disease, Cockayne syndrome, Kearns-Sayre syndrome, Gerstmann-Straussler-Scheinker syndrome and other transmissible spongiform encephalopathies, hereditary spastic paraparesis, Leigh's syndrome, a demyelinating diseases, neuronal ceroid lipofuscinoses, epilepsy, tremors, depression, mania, anxiety and anxiety disorders, sleep disorders (e.g., narcolepsy, fatal familial insomnia), acute brain injuries (e.g., stroke, head injury), autism, Machado-Joseph disease, or a combination thereof. In some embodiments, the neurological disease comprises Friedrich's ataxia or Sturge Weber syndrome. In some embodiments, the neurological disease comprises Huntington's disease. All types of neurological diseases disclosed herein or known in the art are contemplated as being within the scope of the disclosure.

In certain embodiments, the non-proliferative disease is an autoimmune disorder or an immunodeficiency disorder. In certain embodiments, the compound of Formula (I), or a pharmaceutically acceptable salt thereof, or compositions comprising such compound or pharmaceutically acceptable salt thereof, is used to prevent or treat an autoimmune disease, disorder, or condition, or an immunodeficiency disease, disorder, or condition. Exemplary autoimmune and immunodeficiency diseases, disorders, and conditions include arthritis (e.g., rheumatoid arthritis, osteoarthritis, gout), Chagas disease, chronic obstructive pulmonary disease (COPD), dermatomyositis, diabetes mellitus type 1, endometriosis, Goodpasture's syndrome, Graves' disease, Guillain-Barre syndrome (GBS), Hashiomoto's disease, Hidradenitis suppurativa, Kawasaki disease, ankylosing spondylitis, IgA nephropathy, idiopathic thrombocytopenic purpura, inflammatory bowel disease, Crohn's disease, ulcerative colitis, collagenous colitis, lymphocytic colitis, ischemic colitis, diversion colitis, Behcet's syndrome, infective colitis, indeterminate colitisinterstitial cystitis, lupus (e.g., systemic lupus erythematosus, discoid lupus, drug-induced lupus, neonatal lupus), mixed connective tissue disease, morphea, multiple sclerosis, myasthenia gravis, narcolepsy, neuromyotonia, pemphigus vulgaris, pernicious anemia, psoriasis, psoriatic arthritis, polymyositis, primary biliary cirrhosis, relapsing polychondritis, scleroderma, Sjögren's syndrome, Stiff person syndrome, vasculitis, vitiligo, a disorder caused by a GATA2 mutation (e.g., GATA2 deficiency; GATA2 haploinsufficiency; Emberger syndrome; monocytopenia and *Mycobacterium avium* complex/dendritic cell, monocyte, B and NK lymphocyte deficiency; familial myelodysplastic syndrome; acute myeloid leukemia; chronic myelomonocytic leukemia), neutropenia, aplastic anemia, and Wegener's granulomatosis. In some embodiments, the autoimmune or immunodeficiency disorder comprises chronic mucocutaneous candidiasis. All types of autoimmune disorders and immunodeficiency disorders disclosed herein or known in the art are contemplated as being within the scope of the disclosure.

In certain embodiments, the non-proliferative disease is a cardiovascular condition. In certain embodiments, the compound of Formula (I), or a pharmaceutically acceptable salt thereof, or compositions comprising such compound or pharmaceutically acceptable salt thereof, is used to prevent or treat a cardiovascular disease, disorder, or condition. A cardiovascular disease, disorder, or condition may include a condition relating to the heart or vascular system, such as the arteries, veins, or blood. Exemplary cardiovascular diseases, disorders, or conditions include angina, arrhythmias (atrial or ventricular or both), heart failure, arteriosclerosis, atheroma, atherosclerosis, cardiac hypertrophy, cardiac or vascular aneurysm, cardiac myocyte dysfunction, carotid obstructive disease, endothelial damage after PTCA (percutaneous transluminal coronary angioplasty), hypertension including essential hypertension, pulmonary hypertension and secondary hypertension (renovascular hypertension, chronic glomerulonephritis), myocardial infarction, myocardial ischemia, peripheral obstructive arteriopathy of a limb, an organ, or a tissue; peripheral artery occlusive disease (PAOD), reperfusion injury following ischemia of the brain, heart or other organ or tissue, restenosis, stroke, thrombosis, transient ischemic attack (TIA), vascular occlusion, vasculitis, and vasoconstriction. All types of cardiovascular diseases, disorders, or conditions disclosed herein or known in the art are contemplated as being within the scope of the disclosure.

In certain embodiments, the non-proliferative disease is a metabolic disorder. In certain embodiments, the compound of Formula (I), or a pharmaceutically acceptable salt thereof, or compositions comprising such compound or pharmaceutically acceptable salt thereof, is used to prevent or treat a metabolic disease, disorder, or condition. A metabolic disease, disorder, or condition may include a disorder or condition that is characterized by abnormal metabolism, such as those disorders relating to the consumption of food and water, digestion, nutrient processing, and waste removal. A metabolic disease, disorder, or condition may include an acid-base imbalance, a mitochondrial disease, a wasting syndrome, a malabsorption disorder, an iron metabolism disorder, a calcium metabolism disorder, a DNA repair deficiency disorder, a glucose metabolism disorder, hyperlactatemia, a disorder of the gut microbiota. Exemplary metabolic conditions include obesity, diabetes (Type I or Type II), insulin resistance, glucose intolerance, lactose intolerance, eczema, hypertension, Hunter syndrome, Krabbe disease, sickle cell anemia, maple syrup urine disease, Pompe disease, and metachromatic leukodystrophy. All types of metabolic diseases, disorders, or conditions disclosed herein or known in the art are contemplated as being within the scope of the disclosure.

In certain embodiments, the non-proliferative disease is a respiratory condition. In certain embodiments, the compound of Formula (I), or a pharmaceutically acceptable salt thereof, or compositions comprising such compound or pharmaceutically acceptable salt thereof, is used to prevent or treat a respiratory disease, disorder, or condition. A respiratory disease, disorder, or condition can include a disorder or condition relating to any part of the respiratory system, such as the lungs, alveoli, trachea, bronchi, nasal passages, or nose. Exemplary respiratory diseases, disorders, or conditions include asthma, allergies, bronchitis, allergic rhinitis, chronic obstructive pulmonary disease (COPD), lung cancer, oxygen toxicity, emphysema, chronic bronchitis, and acute respiratory distress syndrome. All types of respiratory diseases, disorders, or conditions disclosed herein or known in the art are contemplated as being within the scope of the disclosure.

In certain embodiments, the non-proliferative disease is a renal disease. In certain embodiments, the compound of Formula (I), or a pharmaceutically acceptable salt thereof, or compositions comprising such compound or pharmaceutically acceptable salt thereof, is used to prevent or treat a renal disease, disorder, or condition. A renal disease, disorder, or condition can include a disease, disorder, or condition relating to any part of the waste production, storage, and removal system, including the kidneys, ureter, bladder, urethra, adrenal gland, and pelvis. Exemplary renal diseases include acute kidney failure, amyloidosis, Alport syndrome, adenovirus nephritis, acute lobar nephronia, tubular necrosis, glomerulonephritis, kidney stones, urinary tract infections, chronic kidney disease, polycystic kidney disease, and focal segmental glomerulosclerosis (FSGS). In some embodiments, the renal disease, disorder, or condition comprises HIV-associated nephropathy or hypertensive nephropathy. All types of renal diseases, disorders, or conditions disclosed herein or known in the art are contemplated as being within the scope of the disclosure.

In certain embodiments, the non-proliferative disease is an infectious disease. In certain embodiments, the compound of Formula (I), or a pharmaceutically acceptable salt thereof, or compositions comprising such compound or pharmaceutically acceptable salt thereof, is used to prevent or treat an infectious disease, disorder, or condition. An infectious disease may be caused by a pathogen such as a virus or bacteria. Exemplary infectious diseases include human immunodeficiency syndrome (HIV), acquired immunodeficiency syndrome (AIDS), meningitis, African sleeping sickness, actinomycosis, pneumonia, botulism, *chlamydia*, Chagas disease, Colorado tick fever, cholera, typhus, giardiasis, food poisoning, ebola hemorrhagic fever, diphtheria, Dengue fever, gonorrhea, streptococcal infection (e.g., Group A or Group B), hepatitis A, hepatitis B, hepatitis C, herpes simplex, hookworm infection, influenza, Epstein-Barr infection, Kawasaki disease, kuru, leprosy, leishmaniasis, measles, mumps, norovirus, meningococcal disease, malaria, Lyme disease, listeriosis, rabies, rhinovirus, rubella, tetanus, shingles, scarlet fever, scabies, Zika fever, yellow fever, tuberculosis, toxoplasmosis, or tularemia. In some embodiments, the infectious disease comprises cytomegalovirus. All types of infectious diseases, disorders, or conditions disclosed herein or known in the art are contemplated as being within the scope of the disclosure.

In certain embodiments, the disease, disorder, or condition is a haploinsufficiency disease. In certain embodiments, the compound of Formula (I), or a pharmaceutically acceptable salt thereof, or compositions comprising such compound or pharmaceutically acceptable salt thereof, is used to prevent or treat a haploinsufficiency disease, disorder, or condition. A haploinsufficiency disease, disorder, or condition may refer to a monogenic disease in which an allele of a gene has a loss-of-function lesion, e.g., a total loss of function lesion. In an embodiment, the loss-of-function lesion is present in an autosomal dominant inheritance pattern or is derived from a sporadic event. In an embodiment, the reduction of gene product function due to the altered allele drives the disease phenotype despite the remaining functional allele (i.e. said disease is haploinsufficient with regard to the gene in question). In an embodiment, a compound of Formula (I) increases expression of the haploinsufficient gene locus. In an embodiment, a compound of Formula (I) increases one or both alleles at the haploinsufficient gene locus. Exemplary haploinsufficiency diseases, disorders, and conditions include Robinow syndrome, cardiomyopathy, cerebellar ataxia, pheochromocytoma, Charcot-Marie-Tooth disease, neuropathy, Takenouchi-Kosaki syndrome, Coffin-Siris syndrome 2, chromosome 1p35 deletion syndrome, spinocerebellar ataxia 47, deafness, seizures, dystonia 9, GLUT1 deficiency syndrome 1, GLUT1 deficiency syndrome 2, stomatin-deficient cryohydrocytosis, basal cell carcinoma, basal cell nevus syndrome, medulloblastoma, somatic, brain malformations, macular degeneration, cone-rod dystrophy, Dejerine-Sottas disease, hypomyelinating neuropathy, Roussy-Levy syndrome, glaucoma, autoimmune lymphoproliferative syndrome, pituitary hormone deficiency, epileptic encephalopathy, early infantile, popliteal pterygium syndrome, van der Woude syndrome, Loeys-Dietz syndrome, Skraban-Deardorff syndrome, erythrocytosis, megalencephaly-polymicrogyria-polydactyly-hydrocephalus syndrome, mental retardation, CINCA syndrome, familial cold inflammatory syndrome 1, keratoendothelitis fugax hereditaria, Muckle-Wells syndrome, Feingold syndrome 1, Acute myeloid leukemia, Heyn-Sproul-Jackson syndrome, Tatton-Brown-Rahman syndrome, Shashi-Pena syndrome, Spastic paraplegia, autosomal dominant, macrophthalmia, colobomatous, with microcornea, holoprosencephaly, schizencephaly, endometrial cancer, familial, colorectal cancer, hereditary nonpolyposis, intellectual developmental disorder with dysmorphic facies and behavioral abnormalities, ovarian hyperstimulation syndrome, schizophrenia, Dias-Logan syndrome, premature ovarian failure, dystonia, dopa-responsive, due to sepiapterin reductase deficiency, Beck-Fahrner syndrome, chromosome 2p12-p11.2 deletion syndrome, neuronopathy, spastic paraplegia, familial adult myoclonic, colorectal cancer, hypothyroidism, Culler-Jones syndrome, holoprosencephaly, myelokathexis, WHIM syndrome, Mowat-Wilson syndrome, mental retardation, an intellectual developmental disorder, autism spectrum disorder, epilepsy, epileptic encephalopathy, Dravet syndrome, migraines, a mental retardation disorder (e.g., a disorder caused by a SETD5 gene mutation, e.g., intellectual disability-facial dysmorphism syndrome, autism spectrum disorder), a disorder caused by a GATA2 mutation (e.g., GATA2 deficiency; GATA2 haploinsufficiency; Emberger syndrome; monocytopenia and *Mycobacterium avium* complex/dendritic cell, monocyte, B and NK lymphocyte deficiency; familial myelodysplastic syndrome; acute myeloid leukemia; chronic myelomonocytic leukemia), and febrile seizures.

In certain embodiments, the disease, disorder, or condition is an autosomal recessive disease, e.g., with residual function. In certain embodiments, the compound of Formula (I), or a pharmaceutically acceptable salt thereof, or compositions comprising such compound or pharmaceutically acceptable salt thereof, is used to prevent or treat an autosomal recessive disease, disorder, or condition. An autosomal recessive disease with residual function may refer to a monogenic disease with either homozygous recessive or compound heterozygous heritability. These diseases may also be characterized by insufficient gene product activity (e.g., a level of gene product greater than 0%). In an embodiment, a compound of Formula (I) may increase the expression of a target (e.g., a gene) related to an autosomal recessive disease with residual function. Exemplary autosomal recessive diseases with residual function include Friedreich's ataxia, Stargardt disease, Usher syndrome, chlorioderma, fragile X syndrome, achromatopsia 3, Hurler syndrome, hemophilia B, alpha-1-antitrypsin deficiency, Gaucher disease, X-linked retinoschisis, Wiskott-Aldrich syndrome, mucopolysaccharidosis (Sanfilippo B), DDC deficiency, epidermolysis bullosa dystrophica, Fabry disease, metachromatic leukodystrophy, and odontochondrodysplasia.

In certain embodiments, the disease, disorder, or condition is an autosomal dominant disease. In certain embodiments, the compound of Formula (I), or a pharmaceutically acceptable salt thereof, or compositions comprising such compound or pharmaceutically acceptable salt thereof, is used to prevent or treat an autosomal dominant disease, disorder, or condition. An autosomal dominant disease may refer to a monogenic disease in which the mutated gene is a dominant gene. These diseases may also be characterized by insufficient gene product activity (e.g., a level of gene product greater than 0%). In an embodiment, a compound of Formula (I) may increase the expression of a target (e.g., a gene) related to an autosomal dominant disease. Exemplary autosomal dominant diseases include Huntington's disease, achondroplasia, antithrombin III deficiency, Gilbert's disease, Ehlers-Danlos syndrome, hereditary hemorrhagic telangiectasia, intestinal polyposis, hereditary elliptosis, hereditary spherocytosis, marble bone disease, Marfan's syndrome, protein C deficiency, Treacher Collins syndrome, Von Willebrand's disease, tuberous sclerosis, osteogenesis imperfecta, polycystic kidney disease, neurofibromatosis, and idiopathic hypoparathyroidism.

In certain embodiments, the disease, disorder, or condition is a paralogue activation disorder. In certain embodiments, the compound of Formula (I), or a pharmaceutically acceptable salt thereof, or compositions comprising such compound or pharmaceutically acceptable salt thereof, is used to prevent or treat a paralogue activation disease, disorder, or condition. A paralogue activation disorder may comprise a homozygous mutation of genetic locus leading to loss-of-function for the gene product. In these disorders, there may exist a separate genetic locus encoding a protein with overlapping function (e.g. developmental paralogue), which is otherwise not expressed sufficiently to compensate for the mutated gene. In an embodiment, a compound of Formula (I) activates a gene connected with a paralogue activation disorder (e.g., a paralogue gene).

The cell described herein may be an abnormal cell. The cell may be in vitro or in vivo. In certain embodiments, the cell is a proliferative cell. In certain embodiments, the cell is a cancer cell. In certain embodiments, the cell is a non-proliferative cell. In certain embodiments, the cell is a blood cell. In certain embodiments, the cell is a lymphocyte. In certain embodiments, the cell is a benign neoplastic cell. In certain embodiments, the cell is an endothelial cell. In certain embodiments, the cell is an immune cell. In certain embodiments, the cell is a neuronal cell. In certain embodiments, the cell is a glial cell. In certain embodiments, the cell is a brain cell. In certain embodiments, the cell is a fibroblast. In certain embodiment, the cell is a primary cell, e.g., a cell isolated from a subject (e.g., a human subject).

In certain embodiments, the methods described herein comprise the additional step of administering one or more additional pharmaceutical agents in combination with the compound of Formula (I), a pharmaceutically acceptable salt thereof, or compositions comprising such compound or pharmaceutically acceptable salt thereof. Such additional pharmaceutical agents include, but are not limited to, anti-proliferative agents, anti-cancer agents, anti-diabetic agents, anti-inflammatory agents, immunosuppressant agents, and a pain-relieving agent. The additional pharmaceutical agent(s) may synergistically augment the modulation of splicing induced by the inventive compounds or compositions of this disclosure in the biological sample or subject. Thus, the combination of the inventive compounds or compositions and the additional pharmaceutical agent(s) may be useful in treating, for example, a cancer or other disease, disorder, or condition resistant to a treatment using the additional pharmaceutical agent(s) without the inventive compounds or compositions.

EXAMPLES

In order that the invention described herein may be more fully understood, the following examples are set forth. The examples described in this application are offered to illustrate the compounds, pharmaceutical compositions, and methods provided herein and are not to be construed in any way as limiting their scope.

The compounds provided herein can be prepared from readily available starting materials using modifications to the specific synthesis protocols set forth below that would be well known to those of skill in the art. It will be appreciated that where typical or preferred process conditions (i.e., reaction temperatures, times, mole ratios of reactants, solvents, pressures, etc.) are given, other process conditions can also be used unless otherwise stated. Optimum reaction conditions may vary with the particular reactants or solvents used, but such conditions can be determined by those skilled in the art by routine optimization procedures.

Additionally, as will be apparent to those skilled in the art, conventional protecting groups may be necessary to prevent certain functional groups from undergoing undesired reactions. The choice of a suitable protecting group for a particular functional group as well as suitable conditions for protection and deprotection are well known in the art. For example, numerous protecting groups, and their introduction and removal, are described in Greene et al., *Protecting Groups in Organic Synthesis*, Second Edition, Wiley, New York, 1991, and references cited therein.

Reactions can be purified or analyzed according to any suitable method known in the art. For example, product formation can be monitored by spectroscopic means, such as nuclear magnetic resonance (NMR) spectroscopy (e.g., $^1H$ or $^{13}C$), infrared (IR) spectroscopy, spectrophotometry (e.g., UV-visible), mass spectrometry (MS), or by chromatographic methods such as high performance liquid chromatography (HPLC) or thin layer chromatography (TLC).

Proton NMR: $^1H$ NMR spectra were recorded in $CDCl_3$ solution in 5-mm o.d. tubes (Wildmad) at 24° C. and were collected on a BRUKER AVANCE NEO 400 at 400 MHz for $^1H$. The chemical shifts (δ) are reported relative to tetramethylsilane (TMS=0.00 ppm) and expressed in ppm.

LC/MS: Liquid chromatography-mass spectrometry (LC/MS) was performed on Shimadzu-2020EV using column: Shim-pack XR-ODS (C18, Ø4.6×50 mm, 3 μm, 120 Å, 40° C.) operating in ESI(+) ionization mode; flow rate=1.2 mL/min. Mobile phase=0.05% TFA in water or $CH_3CN$; or on Shimadzu-2020EV using column: Poroshell HPH-C18 (C18, Ø4.6×50 mm, 3 μm, 120 Å, 40° C.) operating in ESI(+) ionization mode; flow rate=1.2 mL/min. Mobile phase A: Water/5 mM $NH_4HCO_3$, Mobile phase B: $CH_3CN$.)

Analytical chiral HPLC: Analytical chiral HPLC was performed on a Agilent 1260 using column: CHIRALPAK IG-3, CHIRALPAK IC-3 or CHIRALPAK OJ-3, with flow rate=1.2 mL/min. Mobile phase=MTBE(DEA):EtOH=50:50).

Preparative HPLC purification: prep-HPLC purification was performed using one of the following HPLC conditions:

Condition 1: Shimadzu, Column: XBridge Prep OBD $C_{18}$ Column, 30 Å-150 mm 5 μm; Mobile Phase A: water (10 mmol/L $NH_4HCO_3$) Mobile Phase B: acetonitrile; Flow rate: 60 mL/min; Gradient 1: 3 B to 3 B in 2 min; Gradient 2: 5% B to 35% B in 6 min; Gradient 3: 3 B to 33 B in 6 min; Gradient 4: 5% B up to 45% in 6 min; Gradient 5: 3% B to 23% B in 6 min; Gradient 6: 10% B to 60% B in 8 min; Gradient 7: 5 B to 45 B in 10 min; Gradient 8: 10% B up to 47% B in 10 min; Gradient 9: 10% B up to 50% B in 8 min; Gradient 9: 5% B to 35% B in 8 min; Gradient 10: 10% B to 48% B in 10 min; Gradient 11: 20% B to 52% B in 8 min; Gradient 12: 20% B to 50% B in 6 min; Gradient 13: 20% B to 43% B in 8 min; Gradient 14: 15% B to 45% B in 8 min; Gradient 14: 10% B to 55% B in 8 min; Gradient 15: 5% B to 38% B in 10 min; Gradient 16: 10% B to 35% B in 8 min; Gradient 17: 5% B to 42% B in 8 min; Gradient 18: 5% B to 30% B in 8 min; Gradient 18: 5% B to 40% B in 8 min; Gradient 19: 5% B to 45% B in 8 min; Gradient 21: 5% B to 37% B in 8 min; Gradient 22: 5% B to 65% B in 8 min; Gradient 23: 10% B to 65% B in 8 min; Gradient 24: 5% B to 50% B in 8 min.

Condition 2: Column: Xselect CSH OBD Column 30*150 mm 5 μm, n; Mobile Phase A: water (10 mmol/L $NH_4HCO_3$); Mobile Phase B: acetonitrile; Flow rate: 60 mL/min; Gradient 1: 10 B to 55 B in 8 min; Gradient 2: 5 B to 50 B in 8 min; Gradient 3: 10 B to 60 B in 10 min; Gradient 4: 10 B to 40 B in 8 min; Gradient 5: 5 B to 65 B in 8 min; Gradient 6: 3% B to 63% B in 6 min; Gradient 7: 10% B to 52% B in 8 min; Gradient 8: 5% B to 37% B in 8 min; Gradient 9: 10% B to 38% B in 8 min; Gradient 10: 3% B to 75% B in 8 min; Gradient 11: 10% B to 42% B in 8 min; Gradient 12: 15% B to 40% B in 10 min; Gradient 13: 10% B to 60% B in 8 min; Gradient 14: 5% B to 35% B in 8 min; Gradient 15: 15% B to 36% B in 8 min.

Condition 3: Column: EP-$C_{18}$M 10 μm 120 A; Mobile Phase A: water (1 mmol/L HCl); Mobile Phase B: acetonitrile; Flow rate: 100 mL/min; Gradient: 40% B to 70% B in 35 min.

Condition 4: Column: Poroshell HPH-C18, 3.0*50 mm, 2.7 um; Mobile Phase A: water (5 mM $NH_4HCO_3$); Mobile Phase B: acetonitrile; Flow rate: 1.2 mL/min; Gradient 1:10% B to 95% B in 1.2 min, hold 0.5 min.

Condition 5: Column: X Select CSH OBD 30×150 mm 5 μm; Mobile phase A: water (0.1% formic acid); Mobile phase B: acetonitrile; Gradient 1: 3% phase B up to 18% in 6 min.

Condition 6: Column: X Select CSH OBD 30×150 mm 5 μm; Mobile phase A: water (0.05% HCl); Mobile phase B: acetonitrile; Flow rate: 60 mL/min; Gradient 1: 3% phase B up to 3% in 2 min; Gradient 2: 3% B to 18% B in 8 min.

Condition 7: Column: X Select CSH OBD 30×150 mm 5 μm; Mobile phase A: water (0.05% formic acid);

Mobile phase B: acetonitrile; Flow rate: 60 mL/min; Gradient 1: 3% phase B up to 20% in 8 min.

Condition 8: Column: YMC-Actus Triart C18, 30 mm×150 mm, 5 μm; Mobile phase A: water (0.05% HCl); Mobile phase B: acetonitrile; Gradient 1: 5% B to 35% B in 8 min.

Condition 9: Column: YMC-Actus Triart C18, 30 mm×150 mm, 5 μm; Mobile phase A: water (10 mmol/L $NH_4HCO_3$); Mobile phase B: acetonitrile; Flow rate: 60 mL/min Gradient 1: 10% B to 70% B in 8 min; Gradient 2: 15% B to 55% B in 8 min; Gradient 3: 5% B to 65% B in 8 min; Gradient 4: 5% B to 45% B in 8 min; Gradient 5:15% B to 45% B in 10 min; Gradient 6: 15% B to 70% B in 8 min; Gradient 7: 5% B to 50% B in 8 min; Gradient 8: 15% B to 50% B in 8 min; Gradient 9: 20% B to 44% B in 10 min.

Preparative chiral HPLC: purification by chiral HPLC was performed on a Gilson-GX 281 using column: CHIRALPAK IG-3, CHIRALPAK IC-3 or CHIRALPAK OJ-3.

Condition 1: Column: CHIRALPAK IG, 3×25 cm, 5 μm; Mobile Phase A: MTBE (0.1% DEA), Mobile Phase B: ethanol; Flow rate: 20 mL/min; Gradient 1: 50 B to 50 B in 18 min.

Reverse flash chromagraphy: purification by reverse flash chromatography was performed using one of the following conditions:

Condition 1: Column, $C_{18}$; Mobile phase: MeOH in water; Gradient 1, 10% to 50% in 1 0 min; Detector, UV 254 nm.

Condition 2: Column, silica gel; Mobile phase: MeOH in water; Gradient 1: 10% to 50% in 10 min; Detector, UV 254 nm.

General Synthetic Schemes

Compounds of the present disclosure may be prepared using a synthetic protocol illustrated in one of Schemes A, B, or C.

Scheme A:

Scheme A.

Steps 1 and 2

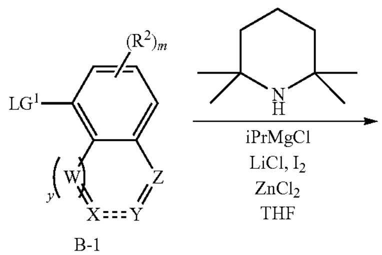

B-1

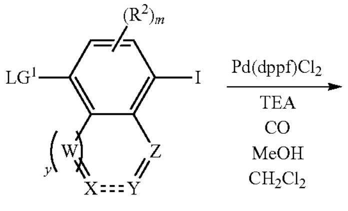

B-2

-continued

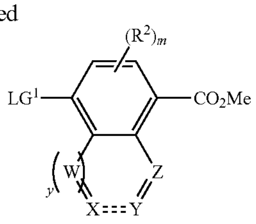

B-3

Steps 3 and 4

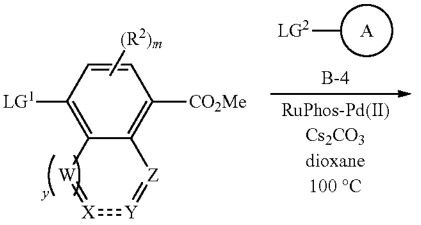

B-3

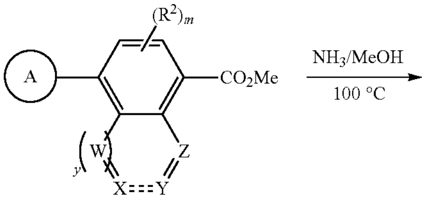

B-5

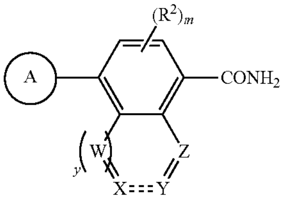

B-6

Step 5

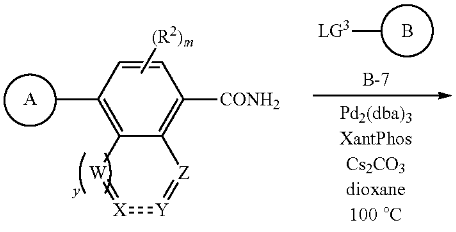

B-6

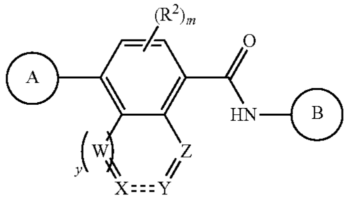

(II-I)

An exemplary method of preparing a compound of Formula (I); wherein A, B, W, X, Y, Z, $R^2$, and m are as defined herein; and $LG^1$, $LG^2$, and $LG^3$ are each independently a leaving group (e.g., halo, —$B(OR^{12})_2$). In some embodiments of the application, y is 0.

An exemplary method of preparing a compound described herein, e.g., a compound of Formula (II-I) is provided in Scheme A. In Step 1, B-2 is prepared by treating B-1 with a mixture of 2,2,6,6-tetramethylpiperidine, isopropylmagnesium chloride (iPrMgCl), lithium chloride (LiCl), iodine ($I_2$), and zinc chloride ($ZnCl_2$) in tetrahydrofuran (THF), or with a similar combination of reagents or solvent. In Step 2, B-3 is prepared by incubating B2 with 1,1'-bis(diphenylphosphino)ferrocene)palladium(II) dichloride (Pd(dppf) $Cl_2$), carbon monoxide (CO), and triethylamine (TEA), in a mixture of methanol (MeOH) and dichloromethane ($CH_2Cl_2$) or a similar mixture of solvents. Alternative catalysts to Pd(dppf)$Cl_2$ may also be used, such as a suitable palladium catalyst, and/or using alternative reagents sufficient to provide B-3.

In Step 3, B-5 is prepared by incubating B-3 with B-4 in the presence of RuPhos-Pd(II) (e.g., RuPhos-Pd(II)-G2 or RuPhos-Pd(II)-G3), and cesium carbonate ($Cs_2CO_3$) or a similar reagent. Step 3 may also be carried out using an alternative catalyst to RuPhos-Pd(II), such as another ruthenium catalyst. The reaction may be conducted in dioxane or a similar solvent, at 100° C. or a temperature sufficient to provide B-5. B-5 is then converted to B-6 by treatment with a mixture of ammonia and methanol, at 100° C. or a temperature sufficient to provide B-6.

B-6 and B-7 are coupled to provide a compound of Formula (II-I) in Step 5. This coupling reaction may be conducted in the presence of tris(dibenzylideneacetone) dipalladium(0) ($Pd_2(dba)_3$, XantPhos, and cesium carbonate or a suitable alternative. Step 5 may also be carried out using an alternative catalyst to $Pd_2(dba)_3$, such as another palladium catalyst, and/or an alternative ligand to XantPhos (e.g., a different phosphine ligand). The reaction may be conducted in dioxane or a similar solvent, at 100° C. or a temperature sufficient to provide the compound of Formula (II-I). Each starting material and/or intermediate in Scheme B may be protected and deprotected using standard protecting group methods. In addition, purification and characterization of each intermediate as well as the final compound of Formula (II) may be afforded by any accepted procedure.

-continued

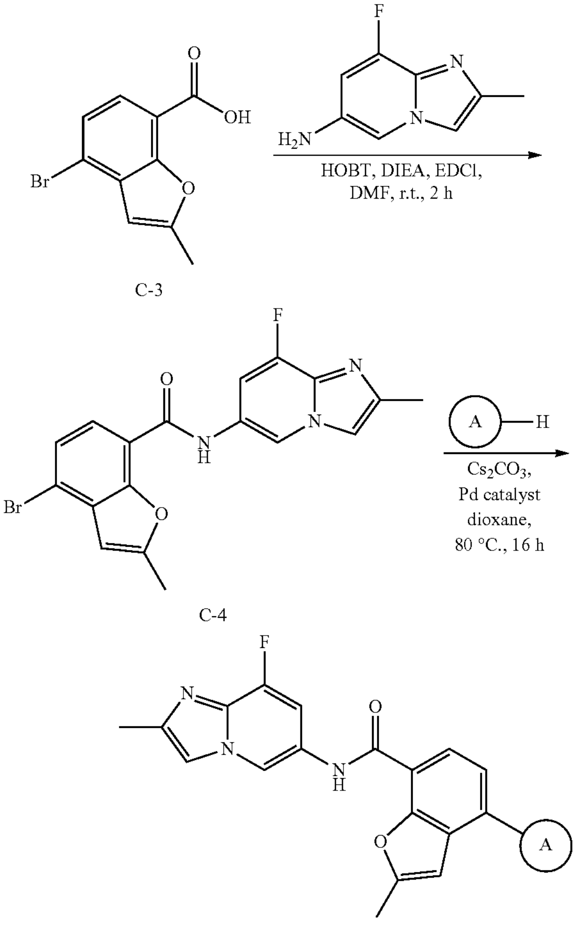

C-3

C-4

(II-I)

An exeplary method of preparing a compound of Formula (I); where A is as defined herein.

Scheme B.

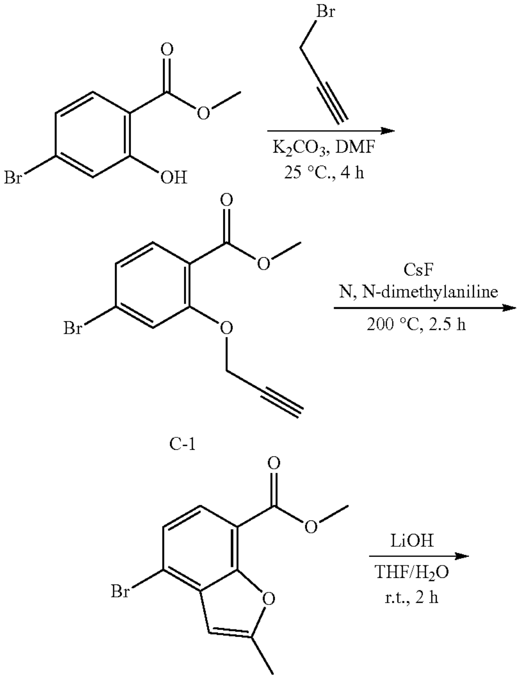

C-1

C-2

Scheme C.

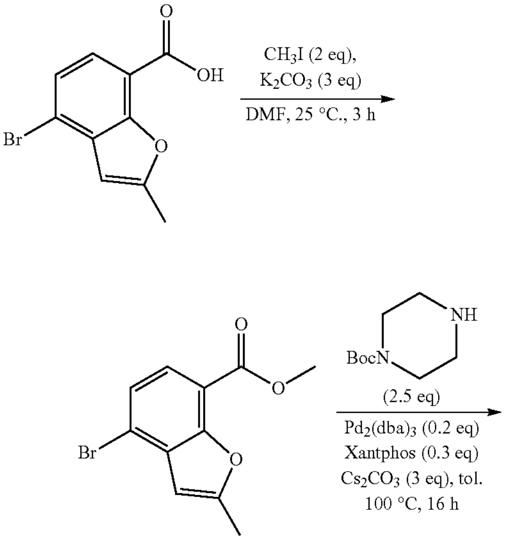

D-1

-continued

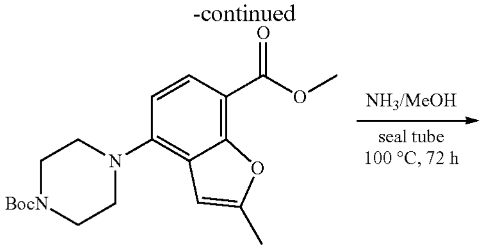

D-2

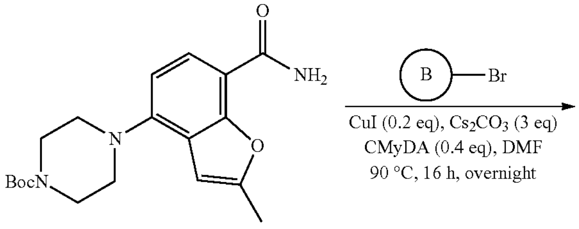

D-3

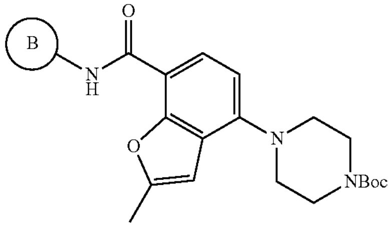

(II-I)

An exemplary method of preparing a compound of Formula (I); where B is as defined herein.

Example 1: Synthesis of Compound 118

Synthesis of Intermediate B72

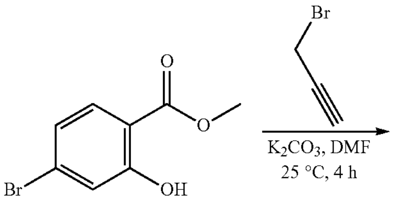

B71

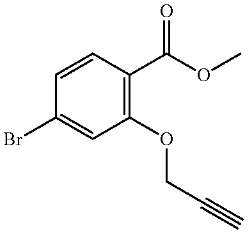

B72

A mixture of methyl 4-bromo-2-hydroxybenzoate (10 g, 43 mmol) and $K_2CO_3$ (18 g, 130 mmol) in dimethylformamide (200 mL) was stirred for 15 min at room temperature under a nitrogen atmosphere. Propargyl bromide (7.2 g, 61 mmol) was then added dropwise, and the resulting mixture was stirred for 4 h. The mixture was then diluted with water (1 L) and extracted with ethyl acetate (2×200 mL). The combined organic layers were washed with brine (2×200 mL), dried over anhydrous $Na_2SO_4$, filtered, and concentrated under reduced pressure, to afford methyl 4-bromo-2-(prop-2-yn-1-yloxy) benzoate (B72; 11.3 g) as a solid. LCMS (ES, m/z): 269 $[M+H]^+$.

Synthesis of Intermediate B73

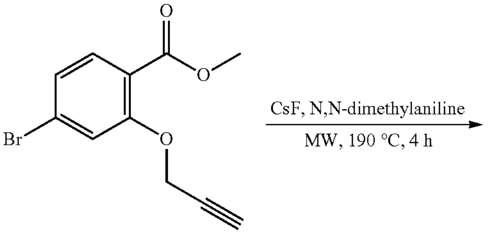

B72

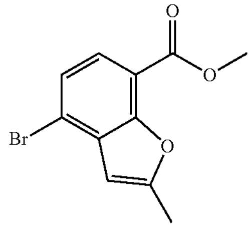

B73

A mixture of methyl 4-bromo-2-(prop-2-yn-1-yloxy) benzoate (B72; 1.13 g, 4.2 mmol) and cesium fluoride (0.64 g, 4.2 mmol) in N,N-dimethylaniline (10 mL) was irradiated with microwave radiation for 4 h at 190° C. The process was repeated 10 times, after which each of the 10 reaction mixtures were combined and dissolved in ethyl acetate (300 mL). The resulting mixture was washed with 4N HCl (3×200 mL), and brine (200 mL), then dried over anhydrous $Na_2SO_4$, filtered, and concentrated under reduced pressure. The crude product was purified by preparative HPLC (Condition 3) to afford methyl 4-bromo-2-methyl-1-benzofuran-7-carboxylate (1.3 g, 11.50%) as an off-white solid. LCMS (ES, m/z): 269 $[M+H]^+$

Synthesis of Intermediate B74

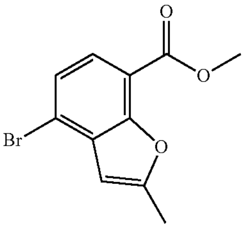

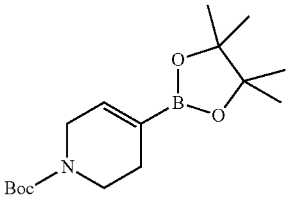

B27

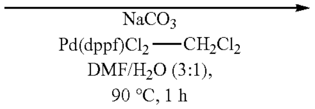

B73

-continued

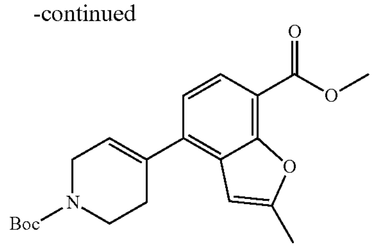

B74

A mixture of methyl 4-bromo-2-methyl-1-benzofuran-7-carboxylate (B73; 450 mg, 1.67 mmol), tert-butyl 4-(4,4,5,5-tetramethyl-1,3,2-dioxaborolan-2-yl)-3,6-dihydro-2H-pyridine-1-carboxylate (B27; 621 mg, 2 mmol), and $Na_2CO_3$ (532 mg, 5 mmol) in dimethylformamide (9 mL) and $H_2O$ (3 mL) was degassed with nitrogen, and then, $Pd(dppf)Cl_2$—$CH_2Cl_2$ (137 mg, 0.17 mmol) was added, and the mixture was stirred for 1 h at 90° C. The resulting mixture was poured into water (50 mL) and extracted with ethyl acetate (2×20 mL). The combined organic layers were dried over anhydrous $Na_2SO_4$, filtered, and concentrated under reduced pressure. The residue was purified by silica gel column chromatography, eluting with petroleum ether/ethyl acetate (20:1-4:1) to afford tert-butyl 4-[7-(methoxycarbonyl)-2-methyl-1-benzofuran-4-yl]-3,6-dihydro-2H-pyridine-1-carboxylate (B74; 620 mg) as an oil. LCMS (ES, m/z): 316 $[M+H-56]^+$, 357 $[M+H-56+ACN]^+$.

Synthesis of Intermediate B75

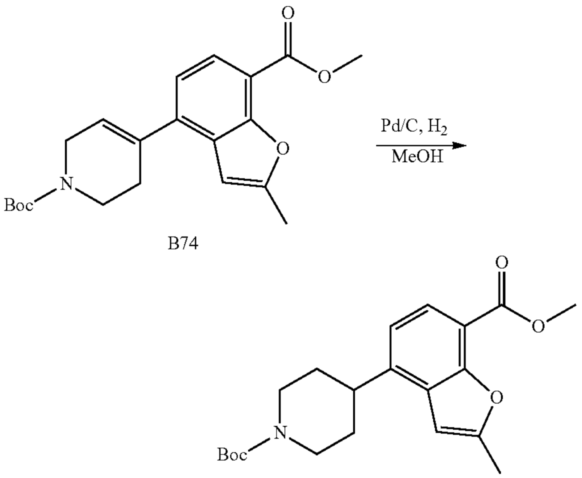

B74

B75

A mixture of tert-butyl 4-[7-(methoxycarbonyl)-2-methyl-1-benzofuran-4-yl]-3,6-dihydro-2H-pyridine-1-carboxylate (B74; 600 mg, 1.62 mmol) and palladium on carbon (100 mg, 0.94 mmol) in methanol (20 mL) was stirred for 1 h at room temperature under a hydrogen atmosphere. The resulting mixture was filtered, the filter cake was washed with methanol, and the filtrate was concentrated under reduced pressure to afford tert-butyl 4-[7-(methoxycarbonyl)-2-methyl-1-benzofuran-4-yl]piperidine-1-carboxylate (B75; 600 mg) as a solid. LCMS (ES, m/z): 318 $[M+H-56]^+$.

Synthesis of Intermediate B76

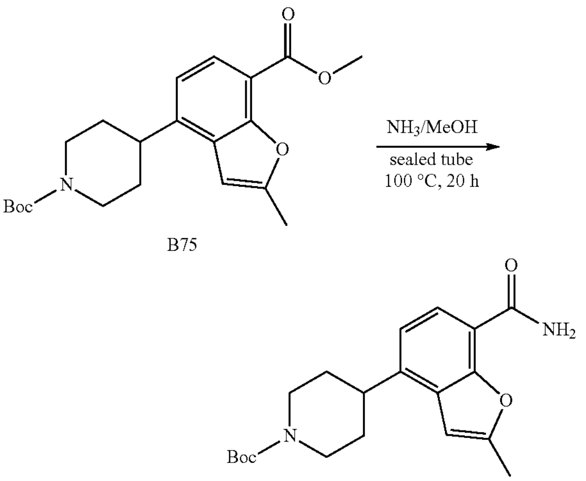

B75

B76

A mixture of tert-butyl 4-[7-(methoxycarbonyl)-2-methyl-1-benzofuran-4-yl]piperidine-1-carboxylate (B75; 600 mg, 1.61 mmol) and ammonia in methanol (60 mL, 2.9 mol) was stirred overnight at 100° C. in a sealed tube. The resulting mixture was concentrated under reduced pressure to afford tert-butyl 4-(7-carbamoyl-2-methyl-1-benzofuran-4-yl)piperidine-1-carboxylate (B76; 570 mg) as a solid. LCMS (ES, m/z): 303 $[M+H-56]^+$.

Synthesis of Intermediate B77

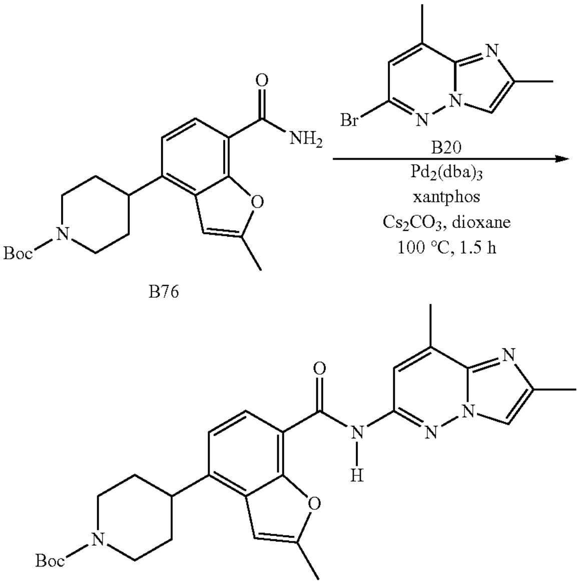

B76

B77

A mixture of tert-butyl 4-(7-carbamoyl-2-methyl-1-benzofuran-4-yl)piperidine-1-carboxylate (B76; 150 mg, 0.42 mmol), 6-bromo-2,8-dimethylimidazo[1,2-b]pyridazine (B20; 95 mg, 0.42 mmol), $Cs_2CO_3$ (409 mg, 1.26 mmol), and XantPhos (24.2 mg, 0.042 mmol) in dioxane (5 mL) was degassed with nitrogen 3 times, then $Pd_2(dba)_3$ (19.2 mg, 0.021 mmol, 0.05 equiv) was added, and the mixture was degassed 3 more times, then stirred for 1.5 h at 100° C. under a nitrogen atmosphere. The resulting mixture was filtered, the filtrate was concentrated under reduced pressure and purified by silica gel column chromatography, eluting with petroleum ether/ethyl acetate (10:1-1:1) to afford tert-butyl 4-[7-([2,8-dimethylimidazo[1,2-b]pyridazin-6-yl]carbamoyl)-2-methyl-1-benzofuran-4-yl]piperidine-1-carboxylate (B77; 170 mg) as a solid. LCMS (ES, m/z): 504 $[M+H]^+$.

Synthesis of Compound 118

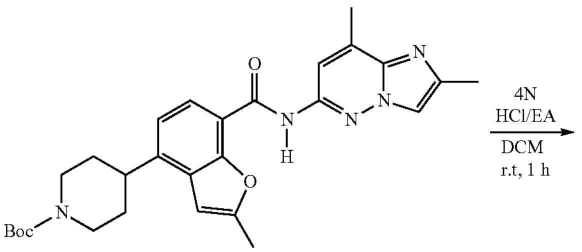

B77

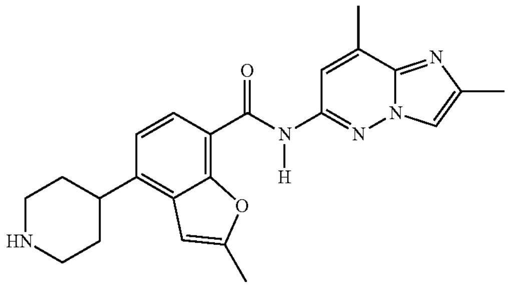

118

A solution of HCl in ethyl acetate (3 mL) was added in portions to a mixture of tert-butyl 4-[7-([2,8-dimethylimidazo[1,2-b]pyridazin-6-yl]carbamoyl)-2-methyl-1-benzofuran-4-yl]piperidine-1-carboxylate (B77; 170 mg, 0.39 mmol) in dichloromethane (3 mL) at room temperature. The resulting mixture was stirred for 1 h at room temperature under nitrogen atmosphere, and then concentrated under reduced pressure. The crude product was purified by preparative HPLC (Condition 2, Gradient 3) to afford N-[2,8-dimethylimidazo[1,2-b]pyridazin-6-yl]-2-methyl-4-(piperidin-4-yl)-1-benzofuran-7-carboxamide (Compound 118; 68.9 mg) as a solid. LCMS (ES, m/z): 404 $[M+H]^+$. $^1H$ NMR (400 MHz, DMSO-d6) δ 10.57 (s, 1H), 7.92 (s, 1H), 7.81 (d, J=1.3 Hz, 1H), 7.69 (d, J=7.9 Hz, 1H), 7.20 (d, J=7.9 Hz, 1H), 6.89 (d, J=1.3 Hz, 1H), 3.07 (d, J=11.9 Hz, 2H), 2.99 (s, 1H), 2.73-2.63 (m, 2H), 2.58 (d, J=1.1 Hz, 3H), 2.53 (d, J=1.1 Hz, 3H), 2.39 (s, 3H), 1.78-1.61 (m, 4H).

Example 2: Synthesis of Compound 149

Synthesis of Intermediate B103

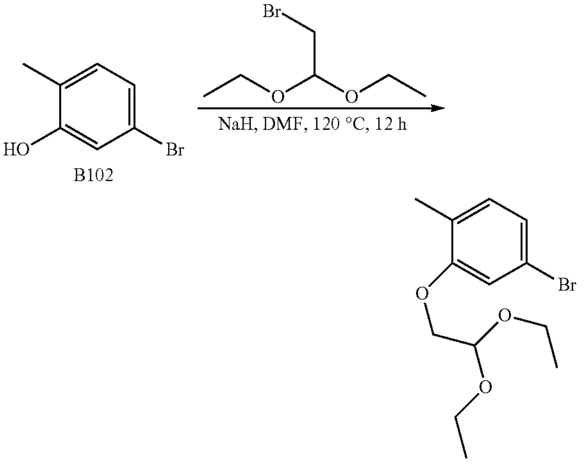

B103

A mixture of 5-bromo-2-methylphenol (B102; 10 g, 53.5 mmol), sodium hydride (2.36 g, 98.4 mmol), and 2-bromo-1,1-diethoxyethane (15.8 g, 80.2 mmol) in dimethylformamide (150 mL) was stirred for 12 h at 120° C. The reaction was then quenched with 500 mL of water/ice, and the pH of the solution was adjusted to 7. The resulting solution was extracted with ethyl acetate (3×200 mL) and dried over anhydrous sodium sulfate. The residue was purified by silica gel column chromatography eluting with ethyl acetate/petroleum ether (1:10), to afford 4-bromo-2-(2,2-diethoxyethoxy)-1-methylbenzene (B103; 9.8 g) as a solid. LCMS (ES, m/z): 303 $[M+H]^+$.

Synthesis of Intermediate B104

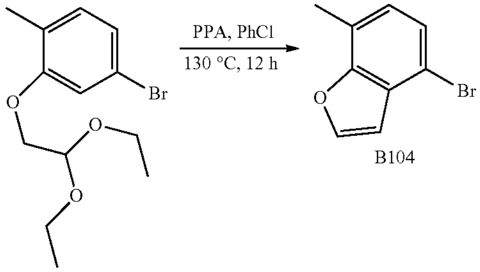

B103

A mixture of 4-bromo-2-(2,2-diethoxyethoxy)-1-methylbenzene (B103; 8.6 g, 26.4 mmol), and polyphosphoric acid (13 g, 113 mmol) in chlorobenzene (200 mL) was stirred for 12 h at 130° C. The resulting mixture was concentrated under reduced pressure and purified by silica gel column chromatography eluting with ethyl acetate/petroleum ether (1:10), to afford 4-bromo-7-methyl-1-benzofuran (B104; 2.40 g) as a solid. LCMS (ES, m/z): 211 $[M+H]^+$.

Synthesis of Intermediate B105

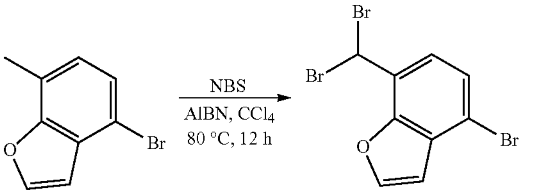

B104 B105

A mixture of 4-bromo-7-methyl-1-benzofuran (B104; 1.5 g, 7.1 mmol), N-bromosuccinimide (3 g, 17 mmol), and azobisisobutyronitrile (187 mg, 1.1 mmol), in carbon tetrachloride (30 mL) was stirred for 12 h at 80° C. The resulting solution was extracted with ethyl acetate (3×50 mL) and dried over anhydrous sodium sulfate. The residue was purified by silica gel column chromatography eluting with ethyl acetate/petroleum ether (1:10), to afford 4-bromo-7-(dibromomethyl)-1-benzofuran (B105; 1.70 g) as a solid. LCMS (ES, m/z): 367 $[M+H]^+$.

Synthesis of Intermediate B106

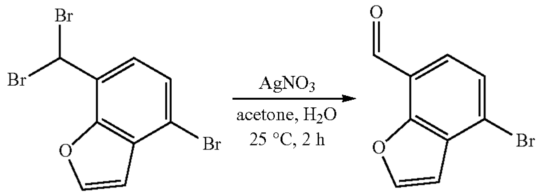

B105 B106

A mixture of 4-bromo-7-(dibromomethyl)-1-benzofuran (B105; 1.56 g, 4.3 mmol) and silver nitrate (2.9 g, 16.9 mmol) in a mixture of acetone (25 mL) and $H_2O$ (5 mL) was stirred for 2 h at 25° C., then filtered. The pH of the solution was adjusted to 8, and the solution was extracted with ethyl acetate (3×100 mL), dried over anhydrous sodium sulfate, and concentrated, to afford 4-bromo-1-benzofuran-7-carbaldehyde (B106; 900 mg) as a solid. LCMS (ES, m/z): 225 $[M+H]^+$.

Synthesis of Intermediate B107

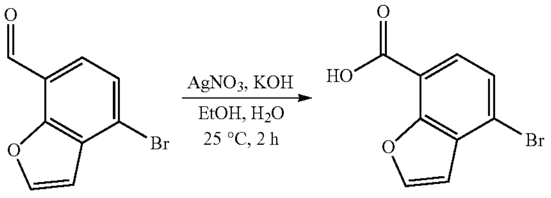

B106 B107

A mixture of 4-bromo-1-benzofuran-7-carbaldehyde (B106; 900 mg, 4 mmol), ethanol (20 mL), silver nitrate (1.4 g, 8 mmol), and potassium hydroxide (898 mg, 16 mmol) in water (20 mL) was stirred for 2 h at 25° C., and then filtered. The pH of the solution was adjusted to 4, and the solution was extracted with ethyl acetate (3×10 mL), dried over anhydrous sodium sulfate, and concentrated, to afford 4-bromo-1-benzofuran-7-carboxylic acid (B107; 900 mg) as a solid. LCMS (ES, m/z): 241 $[M+H]^+$.

Synthesis of Intermediate B108

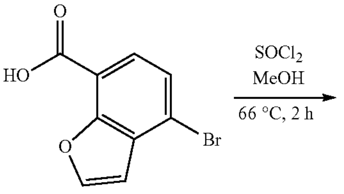

B107

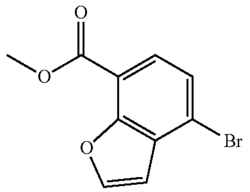

B108

A mixture of 4-bromo-1-benzofuran-7-carboxylic acid (B107; 850 mg, 3.5 mmol) and thionyl chloride (839 mg, 7 mmol) in methanol (18 mL) was stirred for 2 h at 66° C. The reaction was then quenched with methanol, and the residue was purified by silica gel column chromatography eluting with ethyl acetate/petroleum ether (1:10), to afford methyl 4-bromo-1-benzofuran-7-carboxylate (B108; 800 mg) as a solid. LCMS (ES, m/z): 255 $[M+H]^+$.

Synthesis of Intermediate B109

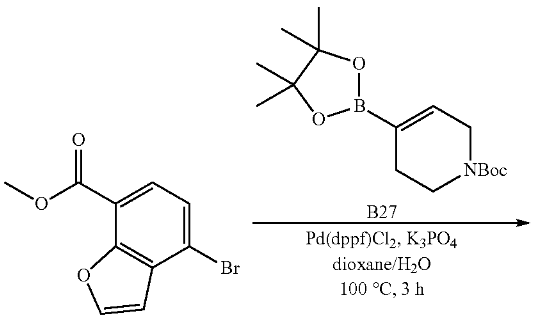

B108

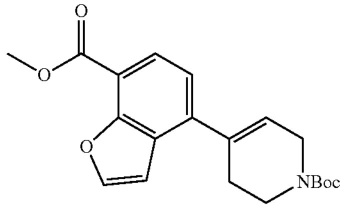

B109

A mixture of methyl 4-bromo-1-benzofuran-7-carboxylate (B108; 260 mg, 1 mmol), tert-butyl 4-(4,4,5,5-tetramethyl-1,3,2-dioxaborolan-2-yl)-3,6-dihydro-2H-pyridine-1-carboxylate (B27; 473 mg, 1.5 mmol), $Pd(dppf)Cl_2$ (75 mg, 0.1 mmol), and $K_3PO_4$ (649 mg, 3 mmol), in dimethylformamide (6 mL) was stirred for 3 h at 100° C. The resulting solution was extracted with ethyl acetate (3×10 mL) and dried over anhydrous sodium sulfate. The residue was purified by silica gel column chromatography eluting with ethyl acetate/petroleum ether (1:4), to afford tert-butyl 4-[7-(methoxycarbonyl)-1-benzofuran-4-yl]-3,6-dihydro-2H-pyridine-1-carboxylate (B109; 400 mg) as a solid. LCMS (ES, m/z): 358 $[M+H]^+$.

Synthesis of Intermediate B110

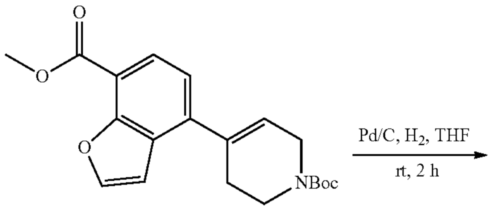

B109

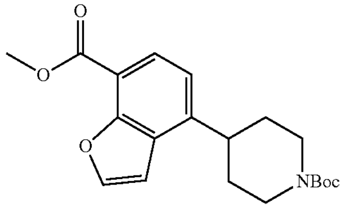

B110

Palladium on carbon (30 mg, 0.28 mmol) was added to a solution of tert-butyl 4-[7-(methoxycarbonyl)-1-benzofuran-4-yl]-3,6-dihydro-2H-pyridine-1-carboxylate (B109; 350 mg, 0.98 mmol) in tetrahydrofuran (15 mL), and the mixture was maintained under a hydrogen atmosphere using a balloon, for 2 h. The mixture was then filtered through a Celite pad and concentrated under reduced pressure, and the residue was purified by reverse phase flash chromatography on a $C_{18}$ column, eluting with acetonitrile/water (10 mmol/L $NH_4HCO_3$), with a gradient of 50% acetonitrile up to 80% over 20 min, to afford tert-butyl 4-[7-(methoxycarbonyl)-1-benzofuran-4-yl]piperidine-1-carboxylate (B110; 280 mg) as an oil. LCMS (ES, m/z): 360 $[M+H]^+$.

Synthesis of Intermediate B111

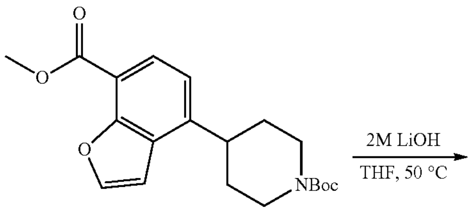

B110

-continued

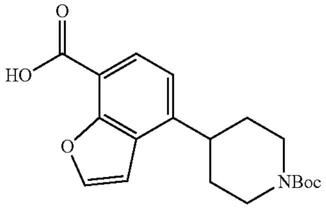

B111

A solution of tert-butyl 4-[7-(methoxycarbonyl)-1-benzofuran-4-yl]piperidine-1-carboxylate (B110; 200 mg, 0.56 mmol) and aqueous lithium hydroxide (2M, 1 mL) in tetrahydrofuran (1 mL) was stirred for 3 h at 50° C. under a nitrogen atmosphere. The resulting mixture was diluted with water (10 mL), and the pH was adjusted to 5 with aqueous HCl. The resulting mixture was extracted with ethyl acetate (3×5 mL), and the combined organic layers were washed with brine (5 mL), dried over anhydrous sodium sulfate, filtered, and concentrated under reduced pressure, to afford 4-[1-(tert-butoxycarbonyl) piperidin-4-yl]-1-benzofuran-7-carboxylic acid (B111; 160 mg) as a solid. LCMS (ES, m/z): 346 $[M+H]^+$.

Synthesis of Intermediate B112

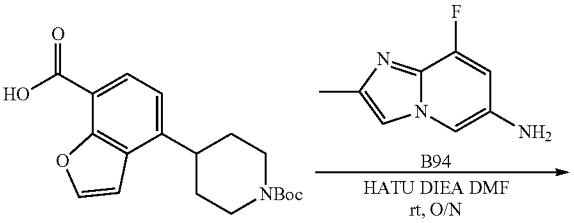

B111

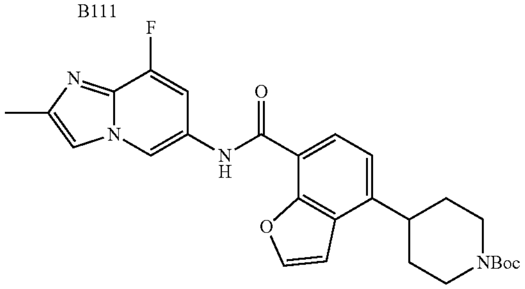

B112

A mixture of 4-[1-(tert-butoxycarbonyl) piperidin-4-yl]-1-benzofuran-7-carboxylic acid (B111; 50 mg, 0.15 mmol) 8-fluoro-2-methylimidazo[1,2-a]pyridin-6-amine (B94; 36 mg, 0.22 mmol), hexafluorophosphate azabenzotriazole tetramethyl uronium (83 mg, 0.22 mmol) and diisopropylethylamine (56 mg, 0.43 mmol) in dimethylformamide (1 mL) was stirred overnight at room temperature under a nitrogen atmosphere. The resulting mixture was diluted with water (10 mL) and extracted with ethyl acetate (3×10 mL). The combined organic layers were washed with brine (10 mL), dried over anhydrous sodium sulfate, filtered, and concentrated under reduced pressure, to afford tert-butyl 4-[7-([8-fluoro-2-methylimidazo[1,2-a]pyridin-6-yl]carbamoyl)-1-benzofuran-4-yl]piperidine-1-carboxylate (B112; 70 mg) as a solid. The crude product was used in the next step directly without further purification. LCMS (ES, m/z): 493 $[M+H]^+$.

Synthesis of Compound 149

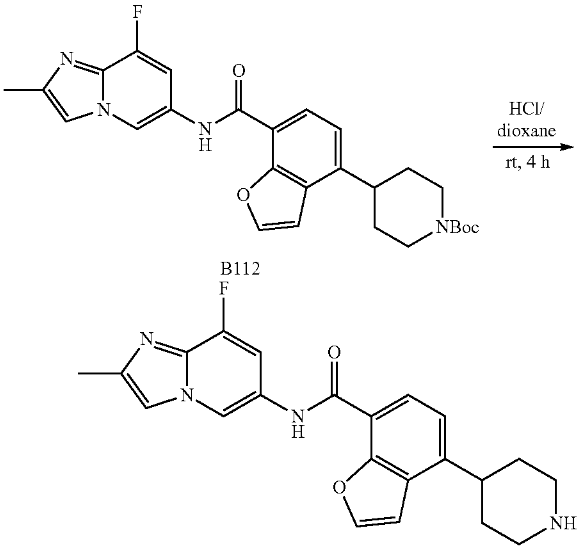

B112

149

A mixture of tert-butyl 4-[7-([8-fluoro-2-methylimidazo[1,2-a]pyridin-6-yl]carbamoyl)-1-benzofuran-4-yl]piperidine-1-carboxylate (B112; 70 mg), HCl in 1,4-dioxane (1 mL), and dioxane (1 mL) was stirred for 4 h at room temperature under a nitrogen atmosphere. The resulting mixture was concentrated under reduced pressure, and purified by preparative HPLC (Condition 2, Gradient 4), to afford N-[8-fluoro-2-methylimidazo[1,2-a]pyridin-6-yl]-4-(piperidin-4-yl)-1-benzofuran-7-carboxamide hydrochloride (Compound 149; 3.9 mg) as a solid. LCMS (ES, m/z): 393 $[M+H]^+$. $^1H$ NMR (400 MHz, DMSO-$d_6$, ppm) δ 10.79 (s, 1H), 9.47 (d, J=1.5 Hz, 1H), 9.15 (d, J=11.3 Hz, 1H), 9.00 (d, J=11.3 Hz, 1H), 8.23 (dd, J=17.9, 2.4 Hz, 2H), 7.85 (d, J=11.9 Hz, 1H), 7.77 (d, J=7.7 Hz, 1H), 7.45 (d, J=2.3 Hz, 1H), 7.26 (d, J=7.9 Hz, 1H), 3.39-3.27 (m, 3H), 3.12 (d, J=12.1 Hz, 1H), 3.06 (d, J=12.0 Hz, 1H), 2.48 (d, J=1.0 Hz, 3H), 2.14 (qd, J=13.3, 4.0 Hz, 2H), 2.01-1.93 (m, 2H).

Example 3: Synthesis of Compound 119

Synthesis of Intermediate B113

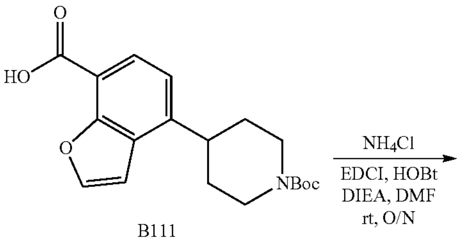

B111

-continued

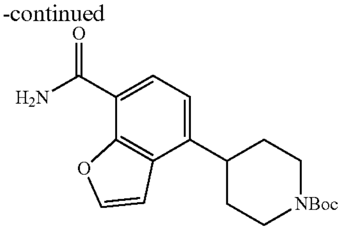

B113

A mixture of 4-[1-(tert-butoxycarbonyl) piperidin-4-yl]-1-benzofuran-7-carboxylic acid (B111 from Example 6, 75 mg, 0.22 mmol), ammonium chloride (17 mg, 0.33 mmol), hydroxybenzotriazole (38 mg, 0.28 mmol), 1-ethyl-3-(3-dimethylaminopropyl)carbodiimide (54 mg, 0.28 mmol) and diisopropylethylamine (84 mg, 0.65 mmol) in dimethylformamide (1 mL) was stirred overnight at room temperature under a nitrogen atmosphere. The resulting mixture was diluted with water (10 mL) and extracted with ethyl acetate (3×5 mL). The combined organic layers were washed with brine (3×5 mL), dried over anhydrous sodium sulfate, filtered, concentrated under reduced pressure, to afford tert-butyl 4-(7-carbamoyl-1-benzofuran-4-yl) piperidine-1-carboxylate (B113; 75 mg) as a solid. LCMS (ES, m/z): 345 $[M+H]^+$.

Synthesis of Intermediate B114

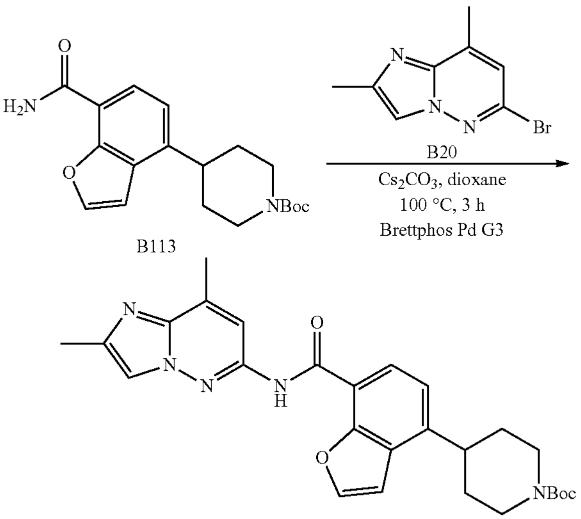

B113

B114

A mixture of tert-butyl 4-(7-carbamoyl-1-benzofuran-4-yl) piperidine-1-carboxylate (B113; 75 mg, 0.22 mmol), BrettPhos Pd G3 (0.66 mg, 0.001 mmol), cesium carbonate (14 mg, 0.044 mmol) and 6-bromo-2,8-dimethylimidazo[1,2-b]pyridazine (B20; 74 mg, 0.33 mmol) in dioxane (0.5 mL) was stirred for 3 h at 100° C. under a nitrogen atmosphere. The resulting mixture was then concentrated under reduced pressure and purified by preparative TLC eluting with dichloromethane/methanol (5:1), to afford tert-butyl 4-[7-([2,8-dimethylimidazo[1,2-b]pyridazin-6-yl]carbamoyl)-1-benzofuran-4-yl]piperidine-1-carboxylate (B114; 90 mg) as a solid. LCMS (ES, m/z): 490 $[M+H]^+$.

Synthesis of Compound 119

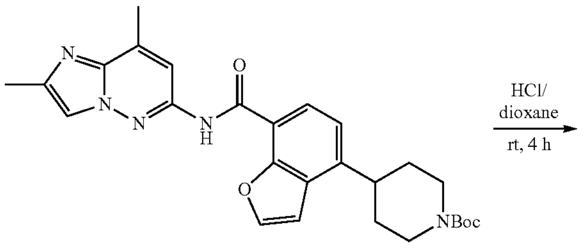

B114

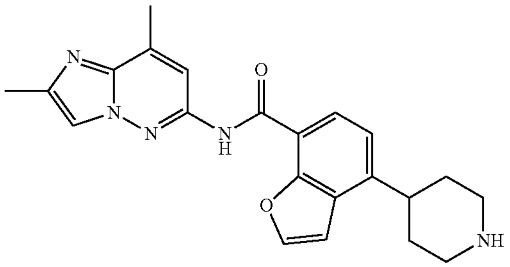

119

A solution of tert-butyl 4-[7-([2,8-dimethylimidazo[1,2-b]pyridazin-6-yl]carbamoyl)-1-benzofuran-4-yl]piperidine-1-carboxylate (B114; 90 mg, 0.18 mmol) and HCl in 1,4-dioxane (0.5 mL, 2 mmol), in dioxane (0.5 mL), was stirred for 4 h at room temperature under a nitrogen atmosphere. The resulting mixture was concentrated under reduced pressure, and purified by preparative HPLC (Condition 1, Gradient 7), to afford N-[2,8-dimethylimidazo[1,2-b]pyridazin-6-yl]-4-(piperidin-4-yl)-1-benzofuran-7-carboxamide (Compound 119; 15.4 mg) as a solid. LCMS (ES, m/z): 390 $[M+H]^+$. $^1$HNMR (400 MHz, DMSO-$d_6$, ppm) δ 8.20 (d, J=2.3 Hz, 1H), 7.93 (s, 1H), 7.86 (d, J=1.3 Hz, 1H), 7.80 (d, J=7.8 Hz, 1H), 7.32-7.25 (m, 2H), 3.11-3.03 (m, 3H), 2.92 (s, 1H), 2.75-2.65 (m, 2H), 2.59 (d, J=1.1 Hz, 3H), 2.39 (s, 3H), 1.79-1.62 (m, 4H).

Example 4: Synthesis of Compound 148

Synthesis of Intermediate B130

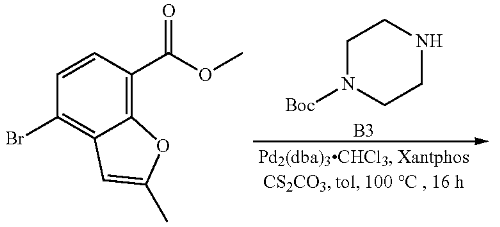

B73

-continued

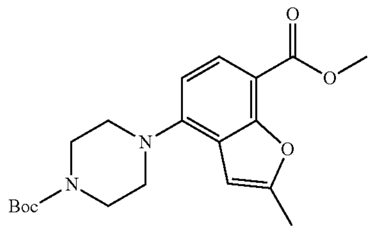

B130

A mixture of methyl 4-bromo-2-methyl-1-benzofuran-7-carboxylate (B73 from Example 18; 700 mg, 2.5 mmol), tert-butyl piperazine-1-carboxylate (B2; 570 mg, 3 mmol), $Pd_2(dba)_3 \cdot CHCl_3$ (132 mg, 0.13 mmol), XantPhos (148 mg, 0.26 mmol) and cesium carbonate (2.5 g, 7.6 mmol) in toluene (10 mL) was stirred for 16 h at 100° C. under a nitrogen atmosphere. The mixture was then cooled to 25° C. and concentrated under vacuum. The residue was purified by silica gel column chromatography eluting with petroleum ether/ethyl acetate (1:1), to afford tert-butyl 4-[7-(methoxycarbonyl)-2-methyl-1-benzofuran-4-yl]piperazine-1-carboxylate (B130; 800 mg) as a solid. LCMS (ES, m/z): 375 $[M+H]^+$.

Synthesis of Intermediate B131

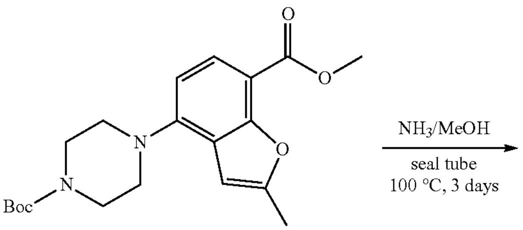

B130

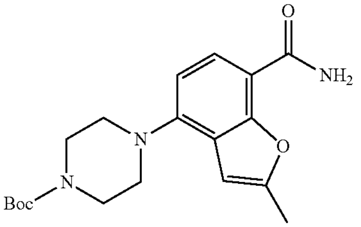

B131

A solution of tert-butyl 4-[7-(methoxycarbonyl)-2-methyl-1-benzofuran-4-yl]piperazine-1-carboxylate (B130; 800 mg, 2 mmol) and ammonia in methanol (80 mL) was stirred for 3 days at 100° C. in a sealed tube. The mixture was then cooled to 25° C. and concentrated under reduced pressure. The residue was purified by silica gel column chromatography eluting with petroleum ether/ethyl acetate (1:1), to afford tert-butyl 4-(7-carbamoyl-2-methyl-1-benzofuran-4-yl)piperazine-1-carboxylate (B131; 600 mg) as a solid. LCMS (ES, m/z): 360 $[M+H]^+$.

Synthesis of Intermediate B132

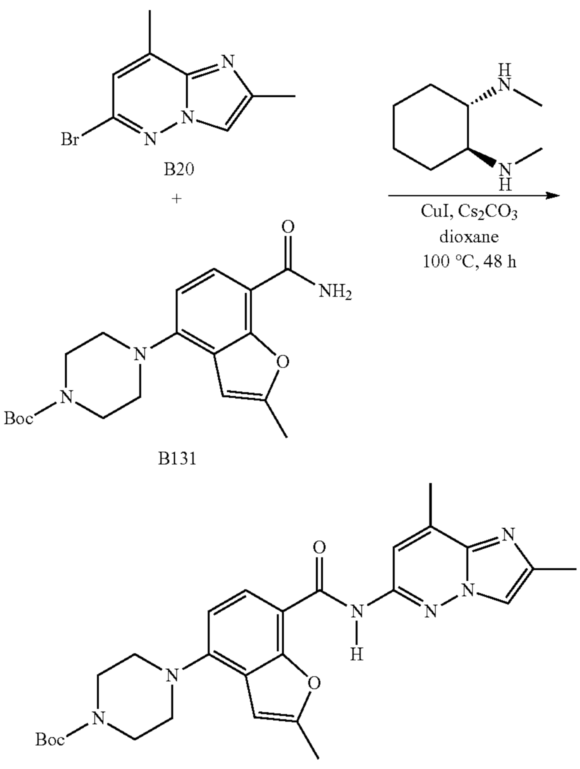

B20
+
B131
B132

A mixture of tert-butyl 4-(7-carbamoyl-2-methyl-1-benzofuran-4-yl)piperazine-1-carboxylate (B131; 150 mg, 0.4 mmol), 6-bromo-2,8-dimethylimidazo[1,2-b]pyridazine (B20; 110 mg, 0.5 mmol), copper(I) iodide (8 mg, 0.04 mmol), $N_1$,$N_2$-dimethylcyclohexane-1,2-diamine (12 mg, 0.08 mmol) and cesium carbonate (400 mg, 1.3 mmol) in 1,4-dioxane (7.5 mL) was stirred for 48 h at 100° C. under an argon atmosphere. The mixture was then cooled to 25° C. and concentrated under vacuum. The residue was purified by silica gel column chromatography, eluting with petroleum ether/ethyl acetate (1:2) to afford tert-butyl 4-[7-([2,8-dimethylimidazo[1,2-b]pyridazin-6-yl]carbamoyl)-2-methyl-1-benzofuran-4-yl]piperazine-1-carboxylate (B132; 20 mg) as a solid. LCMS (ES, m/z): 505 $[M+H]^+$.

Synthesis of Compound 148

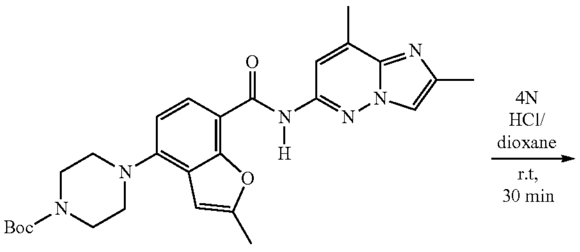

B132

-continued

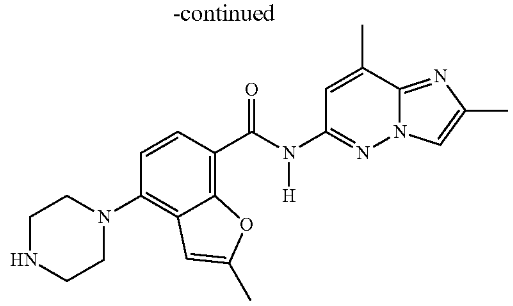

148

A solution of tert-butyl 4-[7-([2,8-dimethylimidazo[1,2-b]pyridazin-6-yl]carbamoyl)-2-methyl-1-benzofuran-4-yl] piperazine-1-carboxylate (B132; 100 mg, 0.19 mmol) and HCl in 1,4-dioxane (5 mL, 88 mmol) was stirred for 30 min at room temperature. The resulting mixture was concentrated under reduced pressure, and purified by preparative HPLC (Condition 1, Gradient 6), to afford N-[2,8-dimethylimidazo[1,2-b]pyridazin-6-yl]-2-methyl-4-(piperazin-1-yl)-1-benzofuran-7-carboxamide (Compound 148; 35.3 mg) as a solid. LCMS (ES, m/z): 405 $[M+H]^+$. $^1H$ NMR (400 MHz, DMSO-$d_6$) δ 10.25 (s, 1H), 7.91 (s, 1H), 7.84 (d, J=1.3 Hz, 1H), 7.72 (d, J=8.4 Hz, 1H), 6.75 (d, J=9.0 Hz, 2H), 3.21 (dd, J=6.1, 3.5 Hz, 4H), 2.92 (t, J=4.8 Hz, 4H), 2.57 (d, J=1.1 Hz, 3H), 2.50 (s, 3H), 2.38 (s, 3H).

Example 5: Synthesis of Compound 142

Synthesis of Intermediate B133

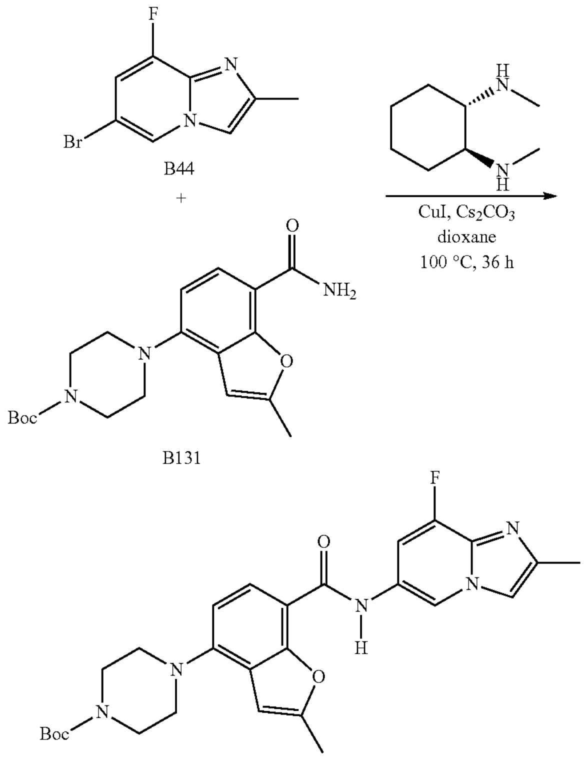

B44
+
B131
B133

A mixture of tert-butyl 4-(7-carbamoyl-2-methyl-1-benzofuran-4-yl)piperazine-1-carboxylate (B131 from Example 30; 150 mg, 0.42 mmol), 6-bromo-8-fluoro-2-methylimidazo[1,2-a]pyridine (B44; 115 mg, 0.5 mmol), copper(I) iodide (8 mg, 0.041 mmol), $N_1$,$N_2$-dimethylcyclohexane-1,2-diamine (12 mg, 0.082 mmol) and cesium carbonate (400 mg, 1.23 mmol) in 1,4-dioxane (7.5 mL) was stirred for 48 h at 100° C. under an argon atmosphere. The mixture was then cooled to 25° C. and concentrated under vacuum. The residue was purified by silica gel column chromatography eluting with petroleum ether/ethyl acetate (1:2), to afford tert-butyl 4-[7-([8-fluoro-2-methylimidazo[1,2-a]pyridin-6-yl]carbamoyl)-2-methyl-1-benzofuran-4-yl]piperazine-1-carboxylate (B133; 20 mg) as a solid. LCMS (ES, m/z): 508 $[M+H]^+$.

Synthesis of Compound 142

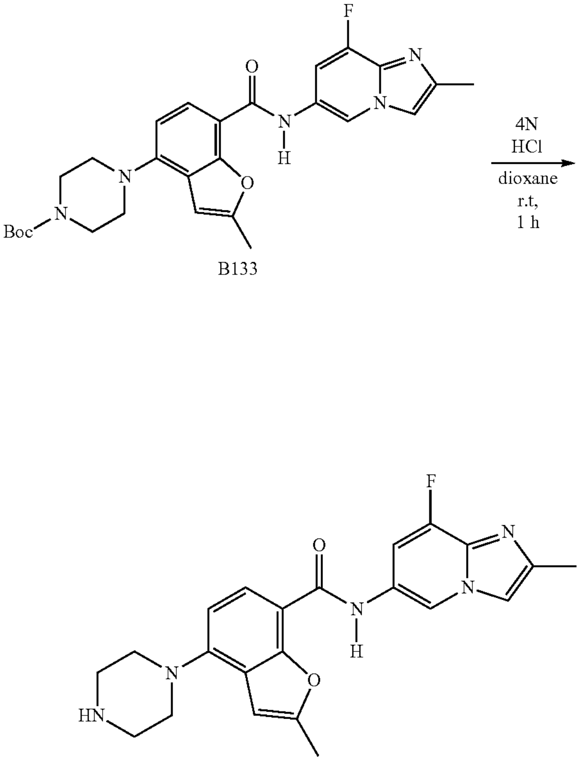

B133

142

A mixture of tert-butyl 4-[7-([8-fluoro-2-methylimidazo[1,2-a]pyridin-6-yl]carbamoyl)-2-methyl-1-benzofuran-4-yl]piperazine-1-carboxylate (B133; 20 mg, 0.04 mmol) and HCl in 1,4-dioxane (1 mL) was stirred for 1 h at 25° C., and the mixture was then concentrated under reduced pressure. The crude product was purified by preparative HPLC (Condition 5, Gradient 1), to afford N-[8-fluoro-2-methylimidazo[1,2-a]pyridin-6-yl]-2-methyl-4-(piperazin-1-yl)-1-benzofuran-7-carboxamide (Compound 142; 4.9 mg) as a solid. LCMS (ES, m/z): 408 $[M+H]^+$. $^1H$ NMR (400 MHz, DMSO-$d_6$) δ 10.04 (d, J=2.2 Hz, 1H), 9.15 (d, J=1.7 Hz, 1H), 8.22 (s, 1H), 7.91 (d, J=3.0 Hz, 1H), 7.61 (d, J=8.3 Hz, 1H), 7.32 (dd, J=12.6, 1.7 Hz, 1H), 6.81-6.74 (m, 2H), 3.27-3.21 (m, 4H), 3.02 (s, 4H), 2.51 (s, 3H), 2.35 (s, 3H).

Example 6: Synthesis of Compound 187

Synthesis of Intermediate B135

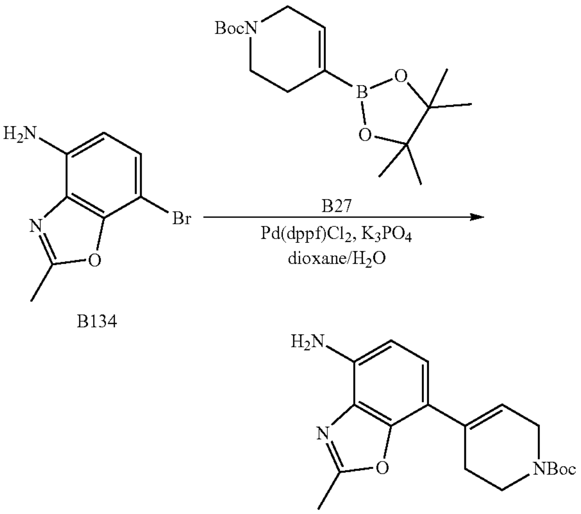

B134

B135

A solution of 7-bromo-2-methyl-1,3-benzoxazol-4-amine (B134; 1 g, 4.32 mmol), tert-butyl 4-(4,4,5,5-tetramethyl-1,3,2-dioxaborolan-2-yl)-3,6-dihydro-2H-pyridine-1-carboxylate (B27; 1.6 g, 5.2 mmol), Pd(dppf)$Cl_2$ $CH_2Cl_2$ (352 mg, 0.43 mmol) and $K_3PO_4$ (2.75 g, 13 mmol) in 1,4-dioxane (12 mL) and $H_2O$ (3 mL) was stirred for 2 h at 80° C. under a nitrogen atmosphere. The mixture was then cooled to 25° C. and concentrated under reduced pressure. The mixture was then poured onto water (100 mL) and extracted with ethyl acetate (3×100 mL), dried over anhydrous sodium sulfate, filtered, and concentrated under reduced pressure. The residue was purified by silica gel column chromatography, eluting with hexane/ethyl acetate (5:1), to afford tert-butyl 4-(4-amino-2-methyl-1,3-benzoxazol-7-yl)piperidine-1-carboxylate (B135; 1.1 g) as a solid. LCMS (ES, m/z): 330 $[M+H]^+$.

Synthesis of Intermediate B136

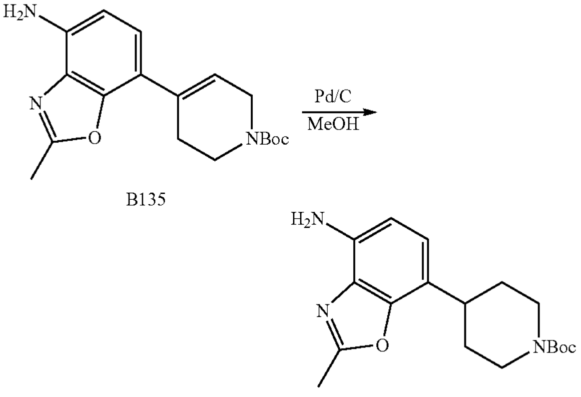

B135

B136

A mixture of tert-butyl 4-(4-amino-2-methyl-1,3-benzoxazol-7-yl)piperidine-1-carboxylate (B135; 1.1 g, 3 mmol) and palladium on carbon (108 mg, 1 mmol) in methanol (30 mL) was stirred for 4 h at 50° C. under a hydrogen atmosphere. The mixture was then cooled to 25° C. and concentrated under vacuum, to afford tert-butyl 4-(4-amino-2-methyl-1,3-benzoxazol-7-yl)piperidine-1-carboxylate (B136; 1.05 g) as a solid. LCMS (ES, m/z): 332 [M+H]$^+$.

Synthesis of Intermediate B137

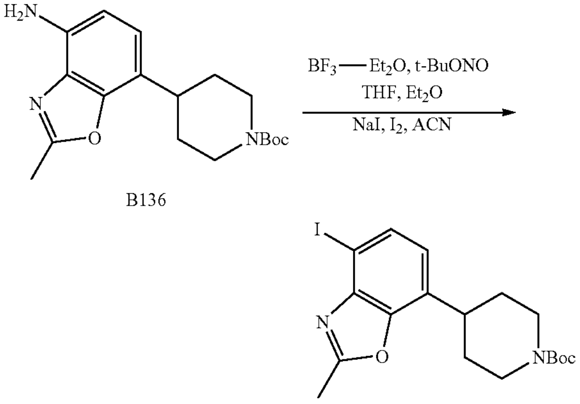

B136

B137

To a solution of tert-butyl 4-(4-amino-2-methyl-1,3-benzoxazol-7-yl)piperidine-1-carboxylate (800 mg, 2.2 mmol) in tetrahydrofuran (16 mL) was added boron trifluoride diethyl etherate (1.37 mL, 9.7 mmol) dropwise at 25° C. A solution of tert-butyl nitrite (851 mg, 8.23 mmol) in tetrahydrofuran (16 mL) was then added dropwise at −50° C., and the mixture was warmed to −5° C. Next, diethyl ether (32 mL) was added and the mixture was stirred for 15 min until a solid precipitated, which was collected and dissolved in acetonitrile (15 mL). Sodium iodide (456 mg, 3 mmol) and iodine (386 mg, 1.5 mmol) were then added, and the resulting mixture was stirred for 15 min at 25° C. The mixture was then partitioned between aqueous sodium sulfite solution and dichloromethane, and the combined organic layers were separated, dried over anhydrous sodium sulfate, filtered, and concentrated under reduced pressure, to afford tert-butyl 4-(4-iodo-2-methyl-1,3-benzoxazol-7-yl) piperidine-1-carboxylate (B137; 700 mg) as a solid. LCMS (ES, m/z): 443 [M+H]$^+$.

Synthesis of Intermediate B138

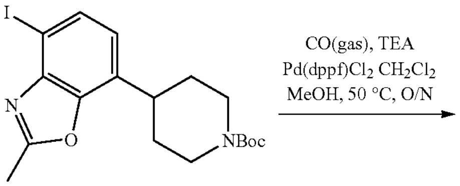

B137

-continued

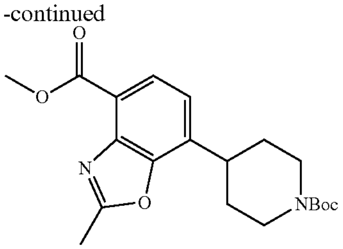

B138

A solution of tert-butyl 4-(4-iodo-2-methyl-1,3-benzoxazol-7-yl)piperidine-1-carboxylate (B137; 650 mg, 1.4 mmol), triethylamine (437 mg, 4.3 mmol) and Pd(dppf)$Cl_2$ $CH_2Cl_2$ (117 mg, 0.14 mmol) in methanol (10 mL) was stirred for 6 h at 50° C. under a carbon monoxide atmosphere. The resulting mixture was concentrated under reduced pressure, and purified by silica gel column chromatography eluting with hexane/ethyl acetate (5:1), to afford methyl 7-[1-(tert-butoxycarbonyl)piperidin-4-yl]-2-methyl-1,3-benzoxazole-4-carboxylate (B138; 350 mg) as a solid. LCMS (ES, m/z): 375 [M+H]$^+$.

Synthesis of Intermediate B139

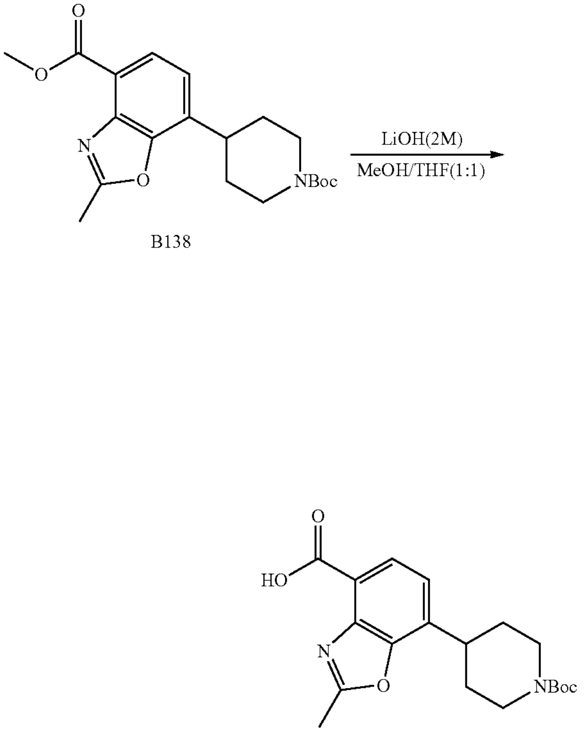

B138

B139

A solution of methyl 7-[1-(tert-butoxycarbonyl)piperidin-4-yl]-2-methyl-1,3-benzoxazole-4-carboxylate (B138; 150 mg, 0.39 mmol) and lithium hydroxide (2M, 393 µL, 0.79 mmol) in methanol (2 mL) and tetrahydrofuran (2 mL) was stirred for 2 h at 40° C. The resulting mixture was concentrated under vacuum, and the crude product (B139; 130 mg) was used in the next step directly without further purification. LCMS (ES, m/z): 361 [M+H]$^+$.

Synthesis of Intermediate B140

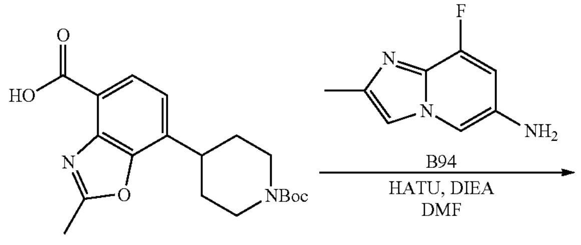

B139

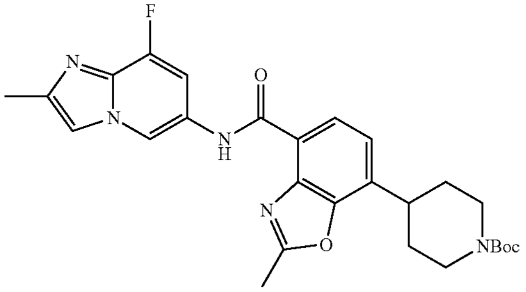

B140

A solution of 7-[1-(tert-butoxycarbonyl)piperidin-4-yl]-2-methyl-1,3-benzoxazole-4-carboxylic acid (B139; 130 mg, 0.4 mmol), 8-fluoro-2-methylimidazo[1,2-a]pyridin-6-amine (B94; 61 mg, 0.4 mmol), hexafluorophosphate azabenzotriazole tetramethyl uronium (161 mg, 0.4 mmol) and diisopropylethylamine (137 mg, 1.0 mmol) in dimethylformamide (2 mL) was stirred for 30 min at 25° C. The resulting mixture was poured into water (20 mL) and extracted with ethyl acetate (2×20 mL). The combined organic layers were washed with brine (2×20 mL), dried over anhydrous sodium sulfate, filtered, and concentrated under reduced pressure. The residue was purified by silica gel column chromatography, eluting with hexane/ethyl acetate (1:1) to afford tert-butyl 4-[4-([8-fluoro-2-methylimidazo[1,2-a]pyridin-6-yl]carbamoyl)-2-methyl-1,3-benzoxazol-7-yl]piperidine-1-carboxylate (B140; 50 mg) as a solid. LCMS (ES, m/z): 508 $[M+H]^+$.

Synthesis of Compound 187

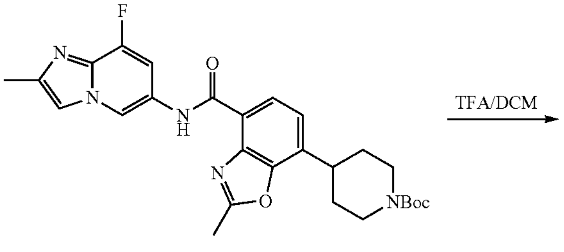

B140

-continued

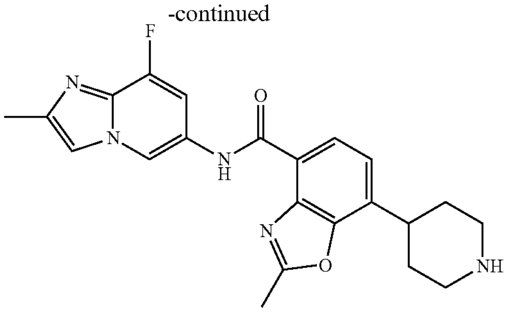

187

A solution of tert-butyl 4-[4-([8-fluoro-2-methylimidazo[1,2-a]pyridin-6-yl]carbamoyl)-2-methyl-1,3-benzoxazol-7-yl]piperidine-1-carboxylate (B140; 50 mg, 0.1 mmol) and trifluoroacetic acid (0.5 mL) in dichloromethane (0.5 mL) was stirred for 30 min at 25° C., and then concentrated under reduced pressure. The crude product was purified by preparative HPLC (Condition 1, Gradient 7), to afford N-[8-fluoro-2-methylimidazo[1,2-a]pyridin-6-yl]-2-methyl-7-(piperidin-4-yl)-1,3-benzoxazole-4-carboxamide (Compound 187; 12.5 mg) as a solid. LCMS (ES, m/z): 408 $[M+H]^+$. $^1H$ NMR (400 MHz, DMSO-$d_6$, ppm) δ 10.79 (s, 1H), 9.18 (d, J=1.7 Hz, 1H), 7.96-7.89 (m, 2H), 7.42 (d, J=8.0 Hz, 1H), 7.33 (dd, J=12.3, 1.7 Hz, 1H), 3.10 (dd, J=10.0, 6.3 Hz, 3H), 2.81 (s, 3H), 2.68 (td, J=11.8, 3.5 Hz, 2H), 2.36 (s, 3H), 1.85-1.69 (m, 4H).

Example 7: Synthesis of Compound 188

Synthesis of Intermediate B141

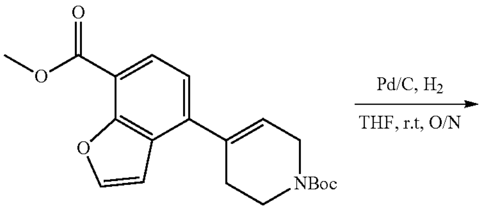

B109

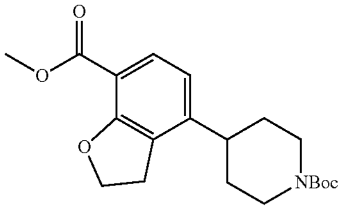

B141

A mixture of tert-butyl 4-[7-(methoxycarbonyl)-1-benzofuran-4-yl]-3,6-dihydro-2H-pyridine-1-carboxylate (B109 from Example 26; 150 mg) in tetrahydrofuran (10 mL) and palladium on carbon (15 mg) was hydrogenated at room temperature overnight using a hydrogen balloon, and was then filtered through a Celite pad and concentrated under reduced pressure, to afford tert-butyl 4-[7-(methoxycarbonyl)-2,3-dihydro-1-benzofuran-4-yl]piperidine-1-carboxylate (B141; 150 mg) as an oil. LCMS (ES, m/z): 362 $[M+H]^+$.

Synthesis of Intermediate B142

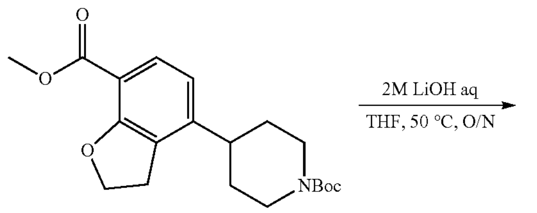

B141

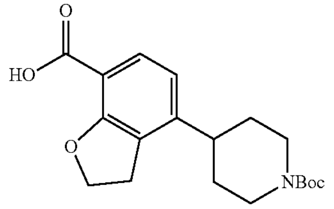

B142

A solution of tert-butyl 4-[7-(methoxycarbonyl)-2,3-dihydro-1-benzofuran-4-yl]piperidine-1-carboxylate (B141; 150 mg), and aqueous lithium hydroxide (2M, 1 mL) was stirred overnight at 50° C. under a nitrogen atmosphere. The pH of the mixture was then adjusted to 5 using aqueous HCl, and the resulting mixture was extracted with ethyl acetate (3×10 mL). The combined organic layers were washed with brine, dried over anhydrous sodium sulfate, filtered, and concentrated under reduced pressure, to afford 4-[1-(tert-butoxycarbonyl) piperidin-4-yl]-2,3-dihydro-1-benzofuran-7-carboxylic acid (B142; 130 mg) as a solid. LCMS (ES, m/z): 348[M+H]$^+$.

Synthesis of Intermediate B143

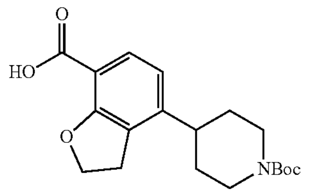

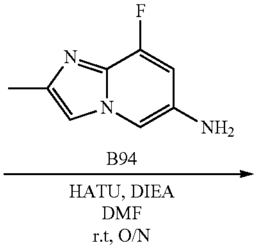

B142

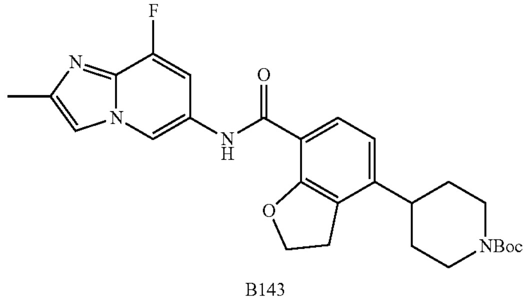

B143

A mixture of 4-[1-(tert-butoxycarbonyl) piperidin-4-yl]-2,3-dihydro-1-benzofuran-7-carboxylic acid (B94; 120 mg, 0.35 mmol), 8-fluoro-2-methylimidazo[1,2-a]pyridin-6-amine (86 mg, 0.5 mmol), hexafluorophosphate azabenzotriazole tetramethyl uronium (197 mg, 0.5 mmol) and diisopropylethylamine (134 mg, 1 mmol) in dimethylformamide (2 mL) was stirred overnight at room temperature under a nitrogen atmosphere. The resulting mixture was diluted with water (10 mL), and the precipitated solids were collected by filtration and washed with water (2×5 mL), to afford tert-butyl 4-[7-([8-fluoro-2-methylimidazo[1,2-a]pyridin-6-yl]carbamoyl)-2,3-dihydro-1-benzofuran-4-yl]piperidine-1-carboxylate (B143; 80 mg) as a solid. LCMS (ES, m/z): 495 [M+H]$^+$.

Synthesis of Compound 188

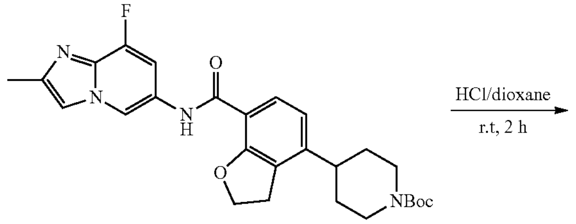

B143

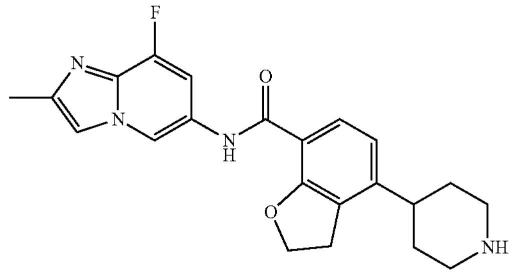

188

A mixture of tert-butyl 4-[7-([8-fluoro-2-methylimidazo[1,2-a]pyridin-6-yl]carbamoyl)-2,3-dihydro-1-benzofuran-4-yl]piperidine-1-carboxylate (B143; 80 mg), HCl in 1,4-dioxane (0.5 mL), and dioxane (0.5 mL) was stirred for 2 h at room temperature under a nitrogen atmosphere. The resulting mixture was then concentrated under reduced pressure and purified by preparative HPLC (Condition 1, Gradient 7), to afford N-[8-fluoro-2-methylimidazo[1,2-a]pyridin-6-yl]-4-(piperidin-4-yl)-2,3-dihydro-1-benzofuran-7-carboxamide (Compound 188; 29.1 mg) as a solid. LCMS (ES, m/z): 395 [M+H]$^+$. $^1$H NMR (400 MHz, DMSO-$d_6$, ppm) δ 9.74 (s, 1H), 9.10 (d, J=1.6 Hz, 1H), 7.90 (dd, J=3.1, 1.0 Hz, 1H), 7.58 (d, J=8.1 Hz, 1H), 7.29 (dd, J=12.6, 1.7 Hz, 1H), 6.90 (d, J=8.1 Hz, 1H), 4.76 (t, J=8.7 Hz, 2H), 3.27 (t, J=8.7 Hz, 3H), 3.04 (d, J=12.4 Hz, 2H), 2.83 (s, 1H), 2.61 (qd, J=11.8, 10.2, 3.0 Hz, 2H), 2.34 (s, 3H), 1.66 (d, J=12.3 Hz, 2H), 1.55 (qd, J=12.1, 3.9 Hz, 2H).

Example 8: Synthesis of Compound 141

Synthesis of Intermediate B201

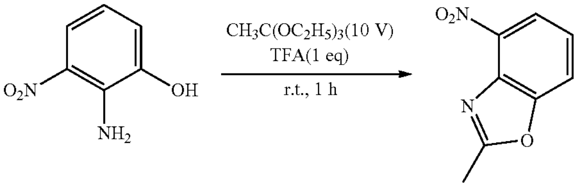

B201

To a stirred solution of 2-amino-3-nitro-phenol (20 g, 127.170 mmol) in triethyl orthoacetate (200 mL) was added TFA (9.45 mL, 82.841 mmol) dropwise at room temperature. The reaction mixture was stirred for 1 h at room temperature, then poured into water (500 mL), extracted with ethyl acetate (3×300 mL). The combined organic layers were washed with brine (2×500 mL), dried over anhydrous $Na_2SO_4$, and filtered. The filtrate was concentrated in vacuo. The residue was purified by silica gel column chromatography, eluted with PE/EA (5:1) to afford 2-methyl-4-nitro-1,3-benzoxazole (6 g, 25.95%) as a solid. LCMS (ES, m/z): 179 $[M+H]^+$.

Synthesis of Intermediate B202

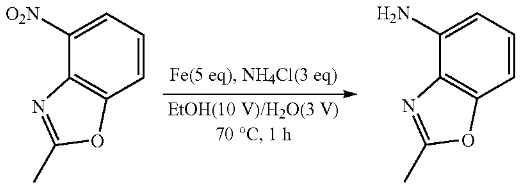

B201 B202

To a stirred solution of 2-methyl-4-nitro-1,3-benzoxazole (5 g, 27.505 mmol) and $NH_4Cl$ (4.41 g, 82.515 mmol) in a mixture of ethanol (50 mL) and $H_2O$ (15.00 mL) was added Fe (7.68 g, 137.525 mmol) portionwise at 70° C. The reaction mixture was stirred at 70° C. for 1 h, then filtered, and the filter cake washed with ethanol (3×50 mL). The filtrate was concentrated in vacuo to afford 2-methyl-1,3-benzoxazol-4-amine (4.2 g, 92.75%) as a solid. LCMS (ES, m/z): 149 $[M+H]^+$.

Synthesis of Intermediate B203

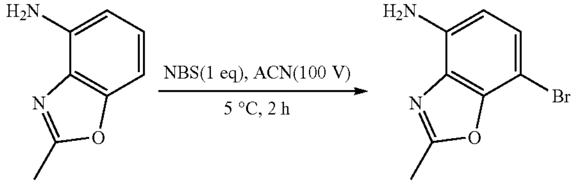

B202 B203

To a stirred solution of 2-methyl-1,3-benzoxazol-4-amine (4 g, 26.457 mmol) in acetonitrile (380 mL) was added NBS (4.71 g, 26.463 mmol) in acetonitrile (20 mL) dropwise at 5° C. The reaction mixture was stirred at 5° C. for 2 h, then poured into water (400 mL), extracted with ethyl acetate (3×400 mL). The combined organic layers were washed with a saturated solution of sodium bicarbonate (2×500 mL), dried over anhydrous $Na_2SO_4$, and filtered. The filtrate was concentrated in vacuo and the residue was purified by silica gel column chromatography, eluted with PE/EA (1:1) to afford 7-bromo-2-methyl-1,3-benzoxazol-4-amine (6 g, 97.88%) as a solid. LCMS (ES, m/z): 227/229 $[M+H]^+$.

Synthesis of Intermediate B204

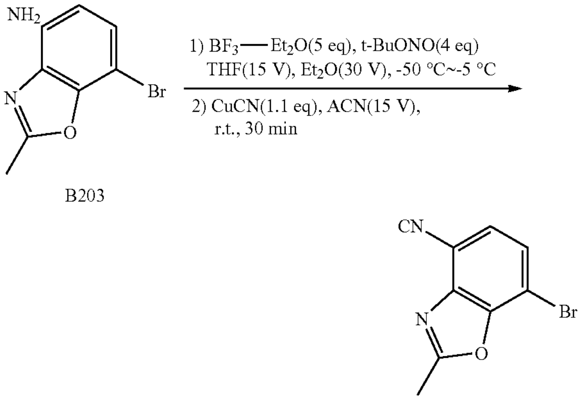

B203

B204

To a stirred solution of 7-bromo-2-methyl-1,3-benzoxazol-4-amine (950 mg, 4.1 mmol) in THF (12.25 mL) was added $BF_3 \cdot Et_2O$ (2.91 g, 20.503 mmol) dropwise at 25° C., followed by t-$BuNO_2$ (1.69 g, 16.389 mmol) in THF (2 mL) dropwise at −50° C. The reaction was then allowed to warm to −5° C. Diethyl ether (28.5 mL) was added and the reaction mixture was stirred at −5° C. for 15 min until a solid precipitated. The solid was collected and dissolved in acetonitrile (14.25 mL). CuCN (403.95 mg, 4.510 mmol) was added into the solution, and the resulting mixture was stirred for 15 min at 25° C. The mixture was partitioned between aqueous sodium sulfite solution and DCM. The combined organic layers were separated, dried over anhydrous $Na_2SO_4$, and filtered. The filtrate was concentrated in vacuo to afford 7-bromo-2-methyl-1,3-benzoxazole-4-carbonitrile (350 mg, 35.29%) as a solid. LCMS (ES, m/z): 237/239 $[M+H]^+$.

Synthesis of Intermediate B205

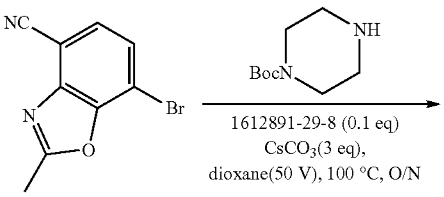

B204

-continued

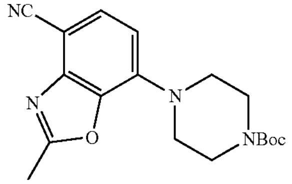

B205

A solution of 7-bromo-2-methyl-1,3-benzoxazole-4-carbonitrile (300 mg, 1.240 mmol), tert-butyl piperazine-1-carboxylate (277 mg, 1.488 mmol), $Cs_2CO_3$ (1.21 g, 3.714 mmol) and Pd-PEPPSI-IPentCl 2-methylpyridine (o-picoline (104 mg, 0.124 mmol) in 1,4-dioxane (15 mL) was stirred at 100° C. overnight under a nitrogen atmosphere. The mixture was allowed to cool to room temperature. The reaction mixture was concentrated in vacuo and the residue was purified by silica gel column chromatography, eluted with PE/EA (1:1) to afford tert-butyl 4-(4-cyano-2-methyl-1,3-benzoxazol-7-yl)piperazine-1-carboxylate (310 mg, 71.54%) as a solid. LCMS (ES, m/z): 343 $[M+H]^+$.

Synthesis of Intermediate B206

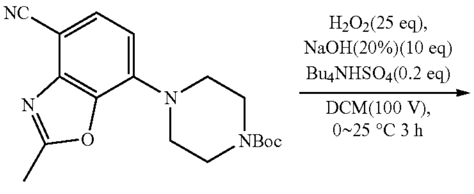

B205

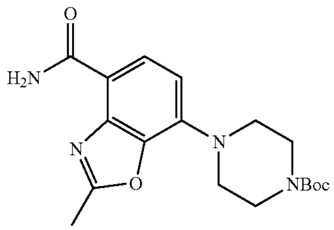

B206

To a stirred solution of tert-butyl 4-(4-cyano-2-methyl-1,3-benzoxazol-7-yl)piperazine-1-carboxylate (130 mg, 0.372 mmol) and $Bu_4NHSO_4$ (25 mg, 0.074 mmol) in DCM (13 mL) was added $H_2O_2$ (30%) (316.41 mg, 9.302 mmol) and sodium hydroxide (20%, aq) (0.60 mL, 3.721 mmol) dropwise at 0° C. The reaction mixture was stirred at 25° C. for 3 h, then extracted with DCM (2×30 mL). The combined organic layers were washed with brine (2×50 mL), dried over anhydrous $Na_2SO_4$, and filtered. The filtrate was concentrated in vacuo and the residue was purified by silica gel column chromatography, eluted with PE/EA (1:1) to afford tert-butyl 4-(4-carbamoyl-2-methyl-1,3-benzoxazol-7-yl) piperazine-1-carboxylate (45 mg, 32.89%) as a solid. LCMS (ES, m/z): 361 $[M+H]^+$.

Synthesis of Intermediate B207

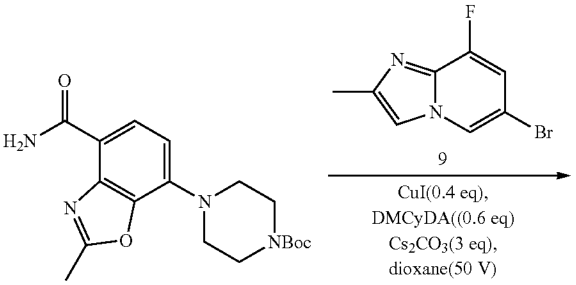

B206

9

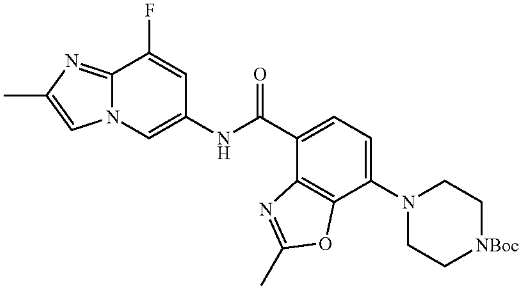

B207

A solution of tert-butyl 4-(4-carbamoyl-2-methyl-1,3-benzoxazol-7-yl)piperazine-1-carboxylate (35 mg, 0.095 mmol), 6-bromo-8-fluoro-2-methylimidazo[1,2-a]pyridine (26 mg, 0.114 mmol), CuI (7 mg, 0.038 mmol), (1R,2R)-1-N,2-N-dimethylcyclohexane-1,2-diamine (8 mg, 0.057 mmol) and $Cs_2CO_3$ (93 mg, 0.285 mmol) in 1,4-dioxane (1.75 mL) was stirred for overnight at 120° C. under a nitrogen atmosphere. The reaction mixture was filtered, the filter cake washed with 1,4-dioxane (2×10 mL), and the filtrate was concentrated in vacuo. The residue was purified by silica gel column chromatography, eluted with DCM/MeOH (10:1) to afford tert-butyl 4-[4-([8-fluoro-2-methylimidazo[1,2-a]pyridin-6-yl]carbamoyl)-2-methyl-1,3-benzoxazol-7-yl]piperazine-1-carboxylate (6 mg, 12.15%) as a brown solid. LCMS (ES, m/z): 509 $[M+H]^+$.

Synthesis of Compound 141

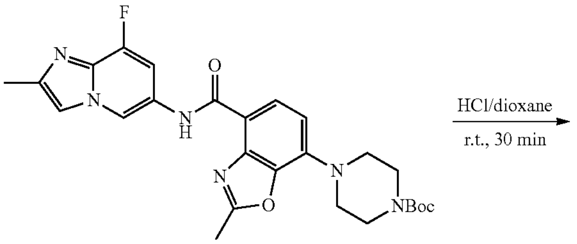

B207

-continued

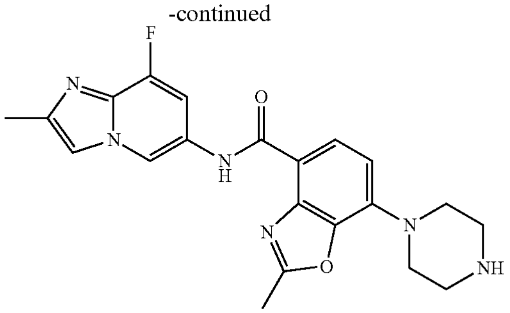

141

A solution of tert-butyl 4-[4-([8-fluoro-2-methylimidazo[1,2-a]pyridin-6-yl]carbamoyl)-2-methyl-1,3-benzoxazol-7-yl]piperazine-1-carboxylate (6 mg, 0.012 mmol) and HCl (gas) in 1,4-dioxane (1 mL) was stirred at 25° C. for 30 min. The reaction mixture was concentrated in vacuo and the crude product was purified by Prep-HPLC (Condition 8, Gradient 1) to afford N-[8-fluoro-2-methylimidazo[1,2-a]pyridin-6-yl]-2-methyl-7-(piperazin-1-yl)-1,3-benzoxazole-4-carboxamide hydrochloride (3.5 mg, 72.63%) as a solid. LCMS (ES, m/z): 409 [M+H]$^+$. $^1$H NMR (400 MHz, DMSO-$d_6$) δ 11.06 (s, 1H), 9.63 (s, 2H), 9.56 (d, J=1.5 Hz, 1H), 8.31 (d, J=2.3 Hz, 1H), 8.12 (dd, J=11.7, 1.6 Hz, 1H), 7.91 (d, J=8.6 Hz, 1H), 7.07 (d, J=8.7 Hz, 1H), 3.79 (t, J=5.2 Hz, 4H), 3.28 (dd, J=16.4, 11.9 Hz, 4H), 2.81 (s, 3H), 2.54 (s, 3H).

Example 9: Synthesis of Compound 208

Synthesis of Intermediate B217

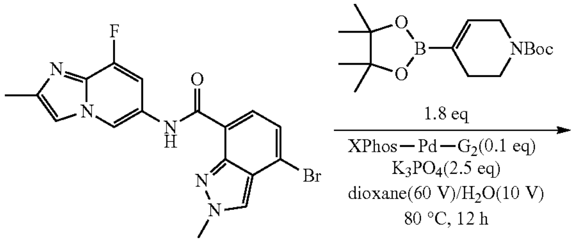

B216

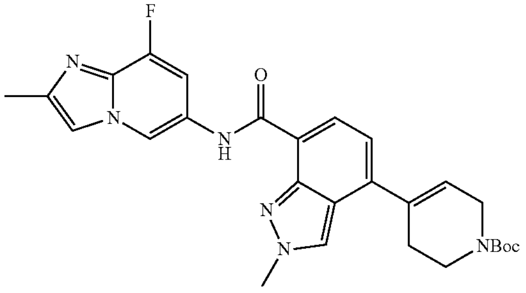

B217

A solution of 4-bromo-N-[8-fluoro-2-methylimidazo[1,2-a]pyridin-6-yl]-2-methylindazole-7-carboxamide (500 mg, 1.24 mmol), tert-butyl 4-(4,4,5,5-tetramethyl-1,3,2-dioxaborolan-2-yl)-3,6-dihydro-2H-pyridine-1-carboxylate (691.8 mg, 2.23 mmol), $K_3PO_4$ (659.6 mg, 3.10 mmol) and XPhos palladium(II) biphenyl-2-amine chloride (97.8 mg, 0.12 mmol) in a mixture of dioxane (30 mL) and $H_2O$ (5 mL) was stirred for 12 h at 80° C. under a nitrogen atmosphere. The reaction mixture was diluted with $H_2O$ (100 mL), extracted with DCM (3×100 mL). The combined organic layers were washed with saturated NaCl (1×100 mL), dried over anhydrous $Na_2SO_4$, and filtered. The filtrate was concentrated in vacuo and the residue was purified by silica gel column chromatography, eluted with DCM/MeOH (97/3) to afford tert-butyl 4-[7-([8-fluoro-2-methylimidazo[1,2-a]pyridin-6-yl]carbamoyl)-2-methylindazol-4-yl]-3,6-dihydro-2H-pyridine-1-carboxylate (590 mg, 94%) as a solid. LCMS (ES, m/z): 505 [M+H]$^+$.

Synthesis of Intermediate B218

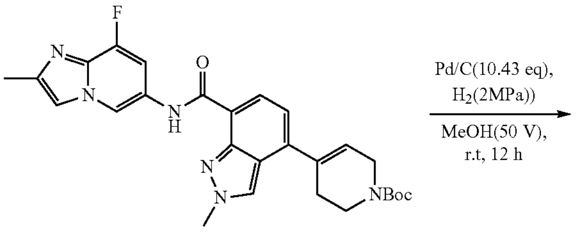

B217

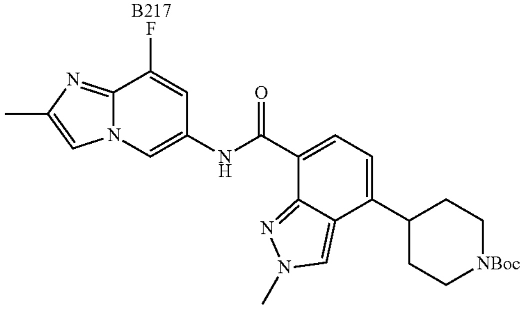

B218

To a solution of tert-butyl 4-[7-([8-fluoro-2-methylimidazo[1,2-a]pyridin-6-yl]carbamoyl)-2-methylindazol-4-yl]-3,6-dihydro-2H-pyridine-1-carboxylate (530.0 mg, 1.05 mmol) in MeOH (30 mL) was added Pd/C (1165.9 mg, 10.95 mmol) in a pressure tank. The mixture was hydrogenated at room temperature under 20 psi of hydrogen pressure for 12 h, filtered through a Celite pad and concentrated in vacuo to afford tert-butyl 4-[7-([8-fluoro-2-methylimidazo[1,2-a]pyridin-6-yl]carbamoyl)-2-methylindazol-4-yl]piperidine-1-carboxylate (306 mg, 57.5%) as a solid. LCMS (ES, m/z): 507 [M+H]$^+$.

Synthesis of Compound 208

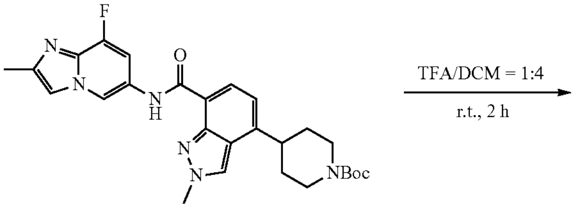

B218

-continued

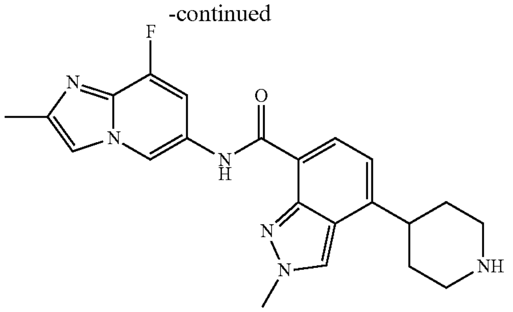

208

A solution of tert-butyl 4-[7-([8-fluoro-2-methylimidazo[1,2-a]pyridin-6-yl]carbamoyl)-2-methylindazol-4-yl]piperidine-1-carboxylate (40 mg, 0.08 mmol) in a mixture of DCM (1.6 mL) and TFA (0.4 mL) was stirred for 1 h at room temperature. The reaction mixture was concentrated in vacuo and the crude product (70 mg) was purified by Prep-HPLC (Condition 9, Gradient 3) to afford N-[8-fluoro-2-methylimidazo[1,2-a]pyridin-6-yl]-2-methyl-4-(piperidin-4-yl)indazole-7-carboxamide (5.1 mg, 15.7%) as a solid. LCMS (ES, m/z): 407 $[M+H]^+$. $^1H$ NMR (400 MHz, DMSO-$d_6$) δ 11.14 (s, 1H), 9.24 (d, J=1.6 Hz, 1H), 8.88 (s, 1H), 8.04 (d, J=7.4 Hz, 1H), 7.93 (d, J=3.0 Hz, 1H), 7.38 (dd, J=12.3, 1.7 Hz, 1H), 7.10 (d, J=7.4 Hz, 1H), 4.35 (s, 3H), 3.08 (dd, J=9.4, 6.3 Hz, 3H), 2.75-2.65 (m, 2H), 2.36 (s, 3H), 1.86-1.78 (m, 2H), 1.72 (tt, J=12.7, 6.4 Hz, 2H). $^{19}F$ NMR (376 MHz, DMSO) δ −131.87.

Example 10: Synthesis of Compound

Synthesis of Intermediate B219

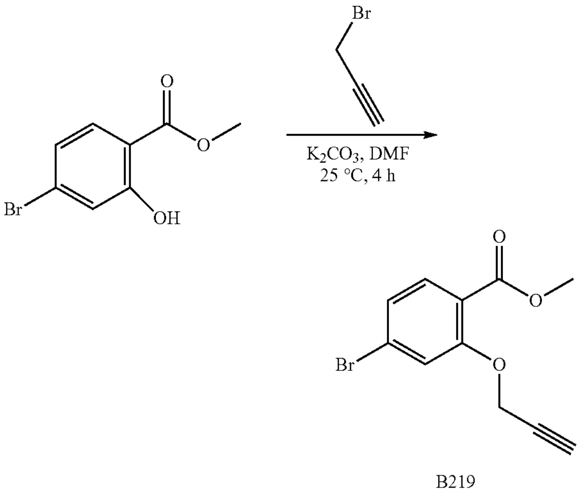

B219

A mixture of methyl 1-(2-hydroxy-4-methylphenyl)acetate (30 g, 165.553 mmol), propargyl bromide (27.57 g, 0.232 mmol), and $K_2CO_3$ (68.64 g, 0.497 mmol) in DMF (300 mL) was stirred for 4 h at 25° C. The reaction mixture was diluted with water, extracted with ethyl acetate (1:1, 3×1 L), and the combined aqueous layers were concentrated in vacuo to afford methyl 1-[4-methyl-2-(prop-2-yn-1-yloxy)phenyl]acetate (23 g, 63.36%) as a solid. LCMS (ES, m/z): 268 $[M+H]^+$.

Synthesis of Intermediate B220

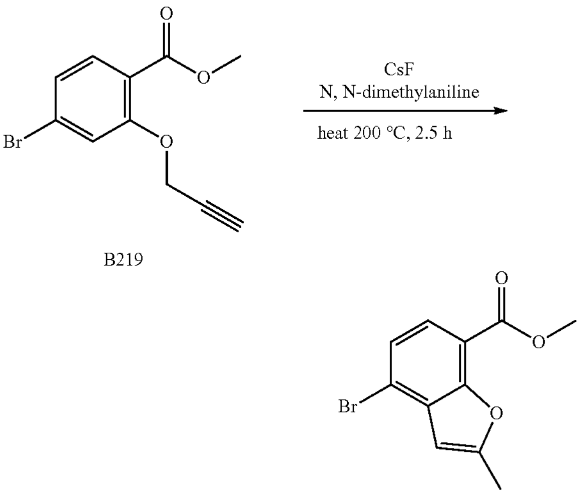

B219

B220

A mixture of methyl 1-[4-bromo-2-(prop-2-yn-1-yloxy)phenyl]acetate (1.00 g, 3.52 mmol) and CsF (0.53 mg, 0.004 mmol) in N,N-dimethylaniline (9 mL) was stirred for 2.5 h at 200° C. The reaction mixture was diluted with water, extracted with ethyl acetate (1:1, 3×1 L), and concentrated in vacuo to afford methyl 1-(4-bromo-2-methyl-1-benzofuran-7-yl)acetate (700 mg, 70%) as a solid. LCMS (ES, m/z): 268 $[M+H]^+$.

Synthesis of Intermediate B221

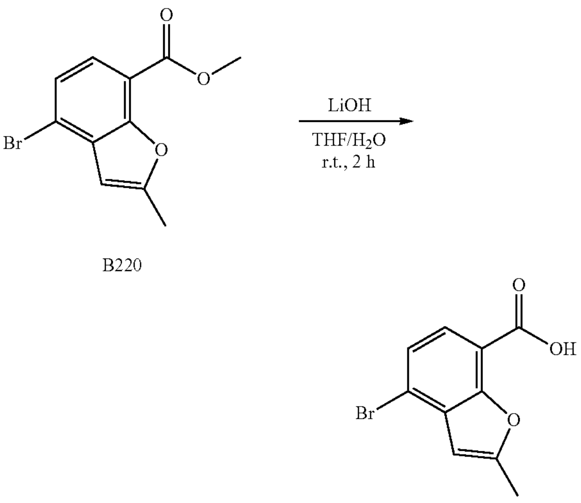

B220

B221

To a stirred solution of methyl 4-bromo-2-methyl-1-benzofuran-7-carboxylate (11.52 g, 42.81 mmol) in THF (440 mL) was added LiOH (2.05 mg, 0.086 mmol) and $H_2O$ (60 mL) in portionwise. The reaction mixture was stirred for 2 h at 25° C., then acidified to pH 5 with HCl (1M), and extracted with ethyl acetate (3×300 mL). The combined organic layers were concentrated in vacuo and the residue was purified by reverse flash chromatography (Condition 2, Gradient 1) to afford 4-bromo-2-methyl-1-benzofuran-7-carboxylic acid (4.5 g, 41%) as a solid. LCMS (ES, m/z): 254 [M+H]$^+$.

Synthesis of Intermediate B222

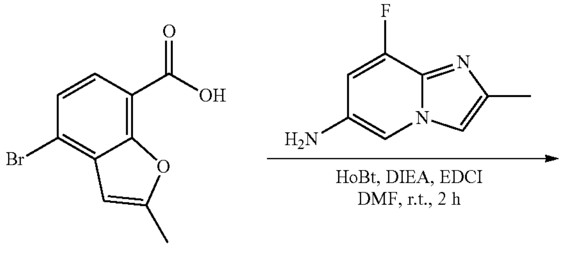

B221

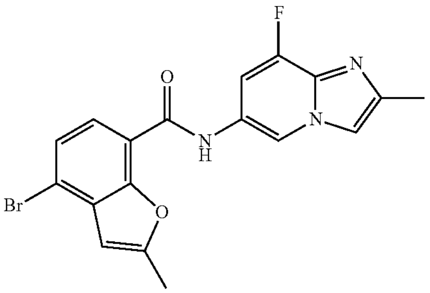

B222

To a stirred solution of 4-bromo-2-methyl-1-benzofuran-7-carboxylic acid (3.5 g, 13.722 mmol) and 8-fluoro-2-methylimidazo[1,2-a]pyridin-6-amine (2.72 g, 0.017 mmol) in DMF (15 mL) were added HoBt (2.22 g, 16.466 mmol), EDCI (3.945 g, 20.583 mmol) and DIEA (7.09 g, 54.888 mmol) portionwise. The reaction mixture was stirred for 2 h at 25° C., then diluted with water, and extracted with ethyl acetate (1:1, 3×20 mL). The combined organic layers were concentrated in vacuo and the crude product (7 g) was purified by Prep-TLC (DCM:MeOH=9:1) to afford 4-bromo-N-[8-fluoro-2-methylimidazo[1,2-a]pyridin-6-yl]-2-methyl-1-benzofuran-7-carboxamide (3.5 g) as a solid. LCMS (ES, m/z): 401 [M+H]$^+$.

Synthesis of Compound 189

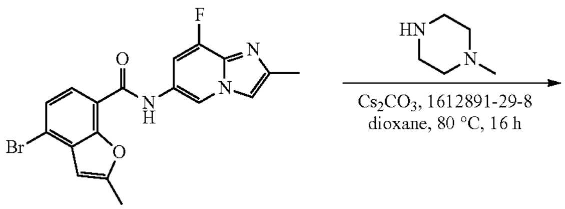

B222

-continued

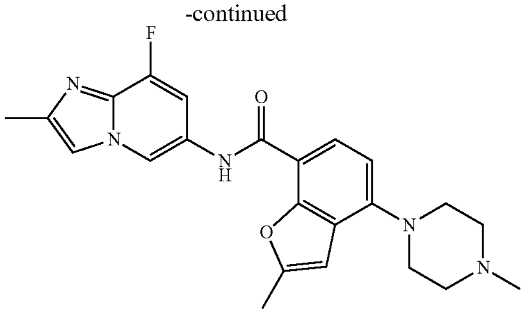

189

A mixture of 4-bromo-N-[8-fluoro-2-methylimidazo[1,2-a]pyridin-6-yl]-2-methyl-1-benzofuran-7-carboxamide (100 mg, 0.249 mmol), 1-methyl-piperazine (29.88 mg, 0.299 mmol), Pd-PEPPSI-IPentCl 2-methylpyridine (o-picoline (20.91 mg, 0.025 mmol), and $Cs_2CO_3$ (243 mg, 0.747 mmol) in dioxane (10.00 mL) was stirred for 16 h at 80° C. under a $N_2$ atmosphere. The mixture was allowed to cool to 25° C., then purified by reverse flash chromatography (Condition 1, Gradient 1) to afford N-[8-fluoro-2-methylimidazo [1,2-a] pyridin-6-yl]-2-methyl-4-(4-methylpiperazin-1-yl)-1-benzofuran-7-carboxamide (37.1 mg, 35.41%) as a solid. LCMS (ES, m/z): 421 [M+H]$^+$. $^1$H NMR (400 MHz, DMSO-$d_6$) δ 10.02 (s, 1H), 9.15 (d, J=1.6 Hz, 1H), 7.91 (dd, J=3.2, 1.0 Hz, 1H), 7.60 (d, J=8.3 Hz, 1H), 7.32 (dd, J=12.7, 1.7 Hz, 1H), 6.80-6.72 (m, 2H), 3.26 (t, J=4.9 Hz, 4H), 2.54 (d, J=4.9 Hz, 4H), 2.52 (s, 3H), 2.37-2.33 (m, 3H), 2.27 (s, 3H). $^{19}$F NMR (376 MHz, DMSO-$d_6$) δ −−132.18.

Example 11: Synthesis of Compound 204

Synthesis of Compound 204

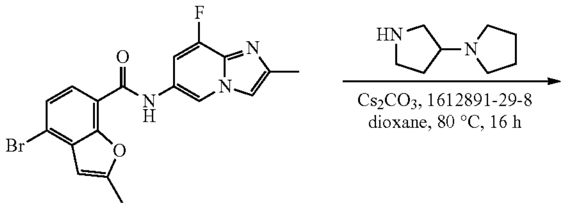

B222

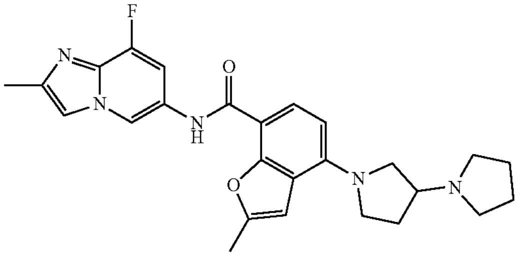

204

A mixture of 4-bromo-N-[8-fluoro-2-methylimidazo[1,2-a]pyridin-6-yl]-2-methyl-1-benzofuran-7-carboxamide (100 mg, 0.249 mmol), 1,3'-bipyrrolidine (41.84 mg, 0.299 mmol), Pd-PEPPSI-IPentCl 2-methylpyridine (o-picoline) (20.91 mg, 0.025 mmol), and $Cs_2CO_3$ (243.01 mg, 0.747 mmol) in dioxane (10 mL) was stirred for 16 h at 80° C.

under a $N_2$ atmosphere. The reaction mixture was allowed to cool to 25° C., then concentrated in vacuo, and purified by reverse flash chromatography (Condition 1, Gradient 1) to afford 4-[[1,3'-bipyrrolidin]-1'-yl]-N-[8-fluoro-2-methylimidazo[1,2-a]pyridin-6-yl]-2-methyl-1-benzofuran-7-carboxamide (25.6 mg, 22.31%) as a solid. LCMS (ES, m/z): 461 $[M+H]^+$. $^1$H NMR (400 MHz, DMSO-$d_6$) δ 9.70 (s, 1H), 9.13 (d, J=1.6 Hz, 1H), 7.89 (dd, J=3.2, 1.0 Hz, 1H), 7.61 (d, J=8.6 Hz, 1H), 7.36 (dd, J=12.8, 1.7 Hz, 1H), 6.94 (d, J=1.2 Hz, 1H), 6.35 (d, J=8.6 Hz, 1H), 3.75-3.70 (dd, J=9.5, 6.6 Hz, 2H), 3.61 (q, J=9.0, 8.6 Hz, 1H), 3.51-3.42 (m, 1H), 2.88 (p, J=6.9 Hz, 1H), 2.56 (d, J=6.4 Hz, 4H), 2.49 (d, J=0.9 Hz, 3H), 2.35 (d, J=0.9 Hz, 3H), 2.15 (m, 1H), 2.01-1.87 (m, 1H), 1.73 (s, 4H). $^{19}$F NMR (376 MHz, DMSO-$d_6$) δ −132.43.

Example 12: Synthesis of Compound 203

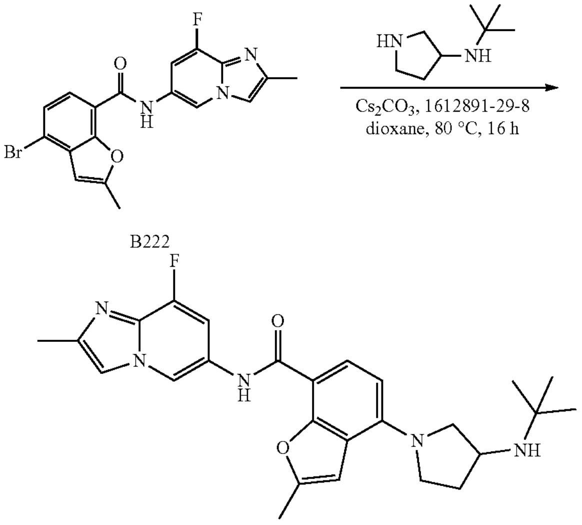

B222

203

To a stirred solution of 4-bromo-N-[8-fluoro-2-methylimidazo[1,2-a]pyridin-6-yl]-2-methyl-1-benzofuran-7-carb oxamide (100 mg, 0.249 mmol) and N-tert-butylpyrrolidin-3-amine (53.05 mg, 0.374 mmol) in dioxane (10 mL) was added $Cs_2CO_3$ (243.01 mg, 0.747 mmol) and Pd-PEPPSI-IPentCl 2-methylpyridine (o-picoline) (41.83 mg, 0.050 mmol) portionwise. The reaction mixture was stirred for 16 h at 80° C. under a $N_2$ atmosphere, then allowed to cool to 25° C., diluted with water, and extracted with ethyl acetate (3×20 mL). The combined organic layers were concentrated under reduced pressure, and the residue was purified by reverse flash chromatography (Condition 1, Gradient 1) to afford 4-[3-(tert-butylamino)pyrrolidin-1-yl]-N-[8-fluoro-2-methylimidazo[1,2-a]pyridin-6-yl]-2-methyl-1-benzofuran-7-carboxamide (56.3 mg, 48.85%) as a solid. LCMS (ES, m/z): 463 $[M+H]^+$. $^1$H NMR (400 MHz, DMSO-$d_6$) δ 9.68 (s, 1H), 9.13 (d, J=1.7 Hz, 1H), 7.89 (dd, J=3.2, 1.0 Hz, 1H), 7.61 (d, J=8.6 Hz, 1H), 7.36 (dd, J=12.8, 1.6 Hz, 1H), 6.87 (d, J=1.2 Hz, 1H), 6.31 (d, J=8.7 Hz, 1H), 3.78 (dd, J=9.4, 6.8 Hz, 1H), 3.64 (s, 1H), 3.56 (q, J=8.6 Hz, 2H), 3.20 (m, 1H), 2.49 (d, J=1.0 Hz, 3H), 2.35 (d, J=0.9 Hz, 3H), 2.17 (d, J=9.6 Hz, 1H), 1.76 (s, 1H), 1.10 (s, 9H). $^{19}$F NMR (376 MHz, DMSO-$d_6$) δ −132.44.

Example 13: Synthesis of Compound 199

Synthesis of Compound 199

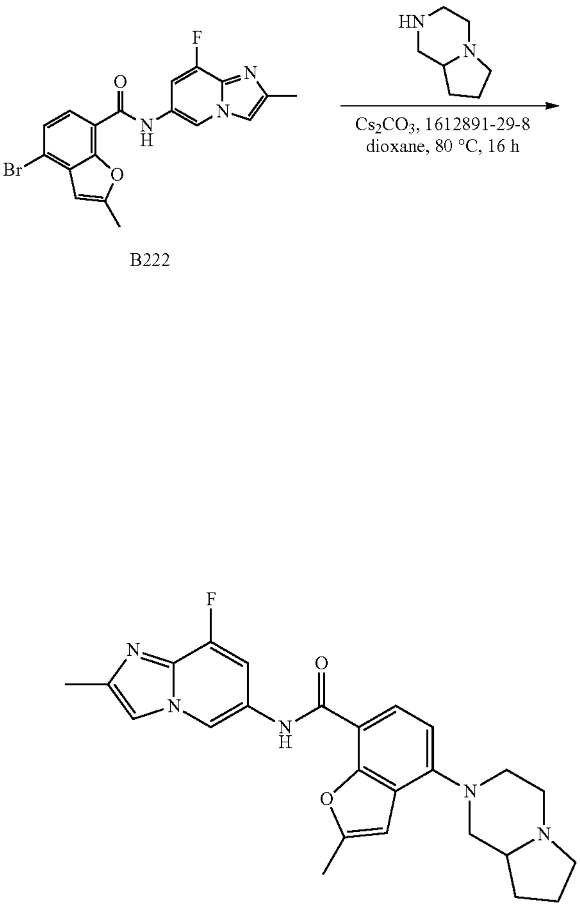

B222

199

A mixture of 4-bromo-N-[8-fluoro-2-methylimidazo[1,2-a]pyridin-6-yl]-2-methyl-1-benzofuran-7-carboxamide (100 mg, 0.249 mmol), octahydropyrrolo[1,2-a]pyrazine (47.06 mg, 0.374 mmol), Pd-PEPPSI-IPentCl 2-methylpyridine (o-picoline) (20.9 mg, 0.025 mmol), and $Cs_2CO_3$ (243 mg, 0.747 mmol) in dioxane (10 mL) was stirred for 16 h at 100° C. under a $N_2$ atmosphere. The reaction mixture was allowed to cool to 25° C., concentrated in vacuo, and the residue purified by reverse flash chromatography (Condition 1, Gradient 1) to afford N-[8-fluoro-2-methylimidazo[1,2-a]pyridin-6-yl]-4-[hexahydro-1H-pyrrolo[1,2-a]pyrazin-2-yl]-2-methyl-1-benzofuran-7-carboxamide (63.4 mg, 56.98%) as a solid. LCMS (ES, m/z): 447 $[M+H]^+$. $^1$H NMR (400 MHz, DMSO-$d_6$) δ 10.01 (s, 1H), 9.15 (d, J=1.6 Hz, 1H), 7.91 (dd, J=3.2, 1.0 Hz, 1H), 7.60 (d, J=8.3 Hz, 1H), 7.32 (dd, J=12.6, 1.6 Hz, 1H), 6.81-6.73 (m, 2H), 3.79 (d, J=11.3 Hz, 1H), 3.67 (d, J=11.8 Hz, 1H), 3.12-3.00 (m, 2H), 2.95 (td, J=11.7, 3.0 Hz, 1H), 2.64 (dd, J=11.5, 10.0 Hz, 1H), 2.51 (d, J=7.5 Hz, 3H), 2.37-2.31 (m, 4H), 2.18 (d, J=8.5 Hz, 1H), 2.11 (dd, J=17.0, 8.4 Hz, 1H), 1.92-1.80 (m, 1H), 1.72 (s, 2H), 1.39 (td, J=11.0, 6.7 Hz, 1H). $^{19}$F NMR (376 MHz, DMSO-$d_6$) δ −132.19.

Example 14: Synthesis of Compound 198

Synthesis of Compound 198

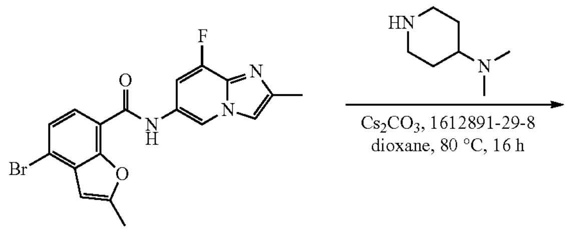

B222

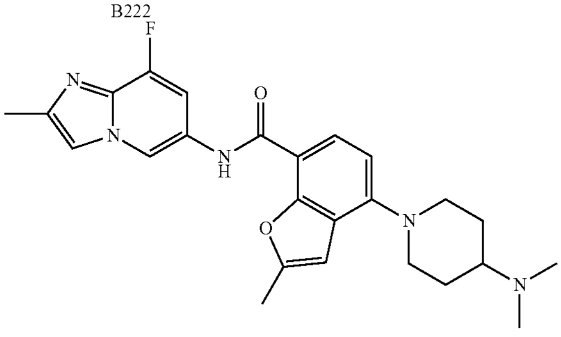

198

A mixture of 4-bromo-N-[8-fluoro-2-methylimidazo[1,2-a]pyridin-6-yl]-2-methyl-1-benzofuran-7-carboxamide (100 mg, 0.249 mmol), N,N-dimethylpiperidin-4-amine (38.25 mg, 0.299 mmol), Pd-PEPPSI-IPentCl 2-methylpyridine (o-picoline) (20.91 mg, 0.025 mmol), and $Cs_2CO_3$ (243 mg, 0.747 mmol) in dioxane (10 mL) was stirred for 16 h at 80° C. under a $N_2$ atmosphere. The reaction mixture was allowed to cool to 25° C., then concentrated in vacuo, and the residue purified by reverse flash chromatography (Condition 1, Gradient 1) to afford 4-[4-(dimethylamino)piperidin-1-yl]-N-[8-fluoro-2-methylimidazo[1,2-a]pyridin-6-yl]-2-methyl-1-benzofuran-7-carboxamide (32.1 mg, 28.72%) as a solid. LCMS (ES, m/z): 449 $[M+H]^+$. $^1$H NMR (400 MHz, DMSO-$d_6$) δ 10.00 (s, 1H), 9.15 (d, J=1.6 Hz, 1H), 7.91 (dd, J=3.1, 1.0 Hz, 1H), 7.59 (d, J=8.3 Hz, 1H), 7.32 (dd, J=12.7, 1.7 Hz, 1H), 6.79-6.70 (m, 2H), 3.74 (d, J=12.3 Hz, 2H), 2.83 (td, J=12.3, 2.3 Hz, 2H), 2.52 (m, 3H), 2.35 (d, J=0.8 Hz, 3H), 2.29 (s, 1H), 2.23 (s, 6H), 1.94-1.85 (m, 2H), 1.60 (qd, J=12.0, 3.8 Hz, 2H). $^{19}$F NMR (376 MHz, DMSO-$d_6$) δ −132.19.

Example 15: Synthesis of Compound 197

Synthesis of Compound 197

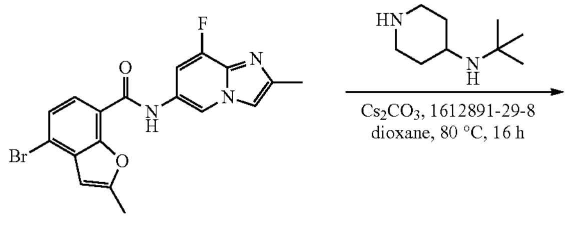

B222

-continued

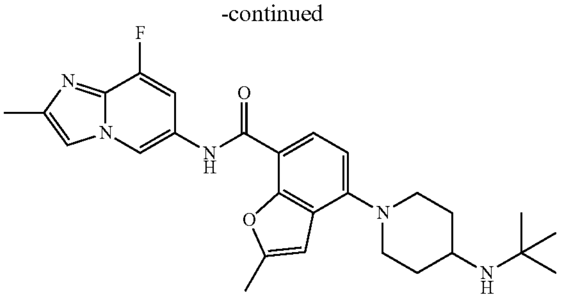

197

A mixture of 4-bromo-N-[8-fluoro-2-methylimidazo[1,2-a]pyridin-6-yl]-2-methyl-1-benzofuran-7-carboxamide (100 mg, 0.249 mmol), N-tert-butylpiperidin-4-amine (52.45 mg, 0.336 mmol), Pd-PEPPSI-IPentCl 2-methylpyridine (o-picoline) (20.91 mg, 0.025 mmol), and $Cs_2CO_3$ (243.01 mg, 0.747 mmol) in dioxane (10 mL) was stirred for 16 h at 80° C. under a $N_2$ atmosphere. The reaction mixture was allowed to cool to 25° C., then concentrated in vacuo. The residue was purified by reverse flash chromatography (Condition 1, Gradient 1) to afford 4-[4-(tert-butylamino)piperidin-1-yl]-N-[8-fluoro-2-methylimidazo [1,2-a]pyridin-6-yl]-2-methyl-1-benzofuran-7-carboxamide (17.3 mg) as a solid. LCMS (ES, m/z): 477 $[M+H]^+$. $^1$H NMR (400 MHz, DMSO-$d_6$) δ 9.98 (s, 1H), 9.15 (d, J=1.6 Hz, 1H), 7.94-7.88 (m, 1H), 7.59 (d, J=8.3 Hz, 1H), 7.32 (dd, J=12.7, 1.7 Hz, 1H), 6.74 (d, J=8.4 Hz, 1H), 6.69 (d, J=1.2 Hz, 1H), 3.63 (d, J=12.3 Hz, 2H), 2.92 (t, J=11.7 Hz, 2H), 2.70 (m, 1H), 2.50 (s, 3H), 2.37 (s, 3H), 1.85 (d, J=12.4 Hz, 2H), 1.48 (d, J=11.7 Hz, 2H), 1.08 (s, 9H). $^{19}$F NMR (376 MHz, DMSO-$d_6$) δ −132.20.

Example 16: Synthesis of Compound 196

Synthesis of Intermediate B223

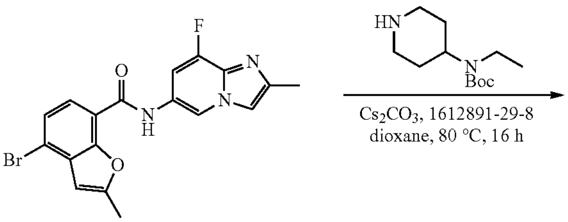

B222

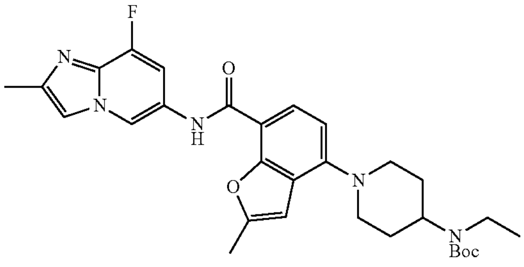

B223

A mixture of 4-bromo-N-[8-fluoro-2-methylimidazo[1,2-a]pyridin-6-yl]-2-methyl-1-benzofuran-7-carboxamide (100 mg, 0.249 mmol), tert-butyl N-ethyl-N-(piperidin-4-yl)carbamate (85.15 mg, 0.374 mmol), Pd-PEPPSI-IPentCl 2-methylpyridine (o-picoline) (41.83 mg, 0.050 mmol), and $Cs_2CO_3$ (243.01 mg, 0.747 mmol) in dioxane (10 mL) was stirred for 16 h at 80° C. under a $N_2$ atmosphere. The reaction mixture was allowed to cool to 25° C., then concentrated in vacuo. The residue was purified by reverse flash chromatography (Condition 1, Gradient 1) to afford tert-butyl N-ethyl-N-[1-[7-([8-fluoro-2-methylimidazo [1,2-a]pyridin-6-yl]carbamoyl)-2-methyl-1-benzofuran-4-yl]piperidin-4-yl]carbamate (105 mg) as a solid. LCMS (ES, m/z): 549 $[M+H]^+$.

Synthesis of Compound 196

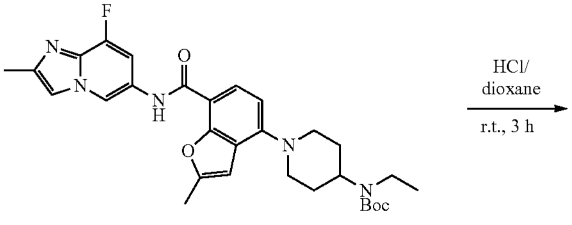

B223

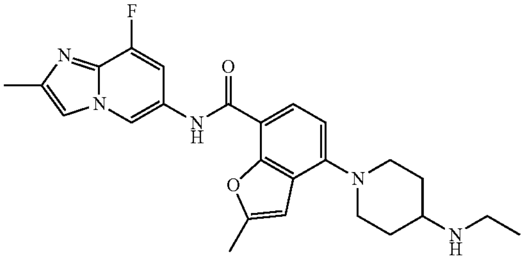

196

To a mixture of tert-butyl N-ethyl-N-[1-[7-([8-fluoro-2-methylimidazo[1,2-a]pyridin-6-yl]carbamoyl)-2-methyl-1-benzofuran-4-yl]piperidin-4-yl]carbamate (95 mg, 0.173 mmol) in dioxane (9 mL) was added HCl (3 mL) in portions. The reaction mixture was stirred for 3 h at 25° C. The resulting mixture was concentrated in vacuo and the residue purified by reverse flash chromatography (Condition 1, Gradient 1) to afford 4-[4-(ethylamino)piperidin-1-yl]-N-[8-fluoro-2-methylimidazo[1,2-a]pyridin-6-yl]-2-methyl-1-benzofuran-7-carboxamide (22 mg, 28.32%) as a solid. LCMS (ES, m/z): 449 $[M+H]^+$. $^1H$ NMR (400 MHz, DMSO-$d_6$) δ 9.99 (s, 1H), 9.15 (d, J=1.6 Hz, 1H), 7.91 (dd, J=3.2, 1.0 Hz, 1H), 7.59 (d, J=8.3 Hz, 1H), 7.32 (dd, J=12.7, 1.7 Hz, 1H), 6.75 (d, J=8.4 Hz, 1H), 6.70 (d, J=1.3 Hz, 1H), 3.66 (d, J=12.6 Hz, 2H), 2.95-2.84 (m, 2H), 2.62 (q, J=7.0 Hz, 3H), 2.50 (s, 3H), 2.35 (s, 3H), 1.99-1.92 (m, 2H), 1.48 (d, J=11.1 Hz, 1H), 1.43 (d, J=11.4 Hz, 1H), 1.05 (t, J=7.1 Hz, 3H). $^{19}F$ NMR (376 MHz, DMSO-$d_6$) δ −132.20.

Example 17: Synthesis of Compound 209

Synthesis of Compound 209

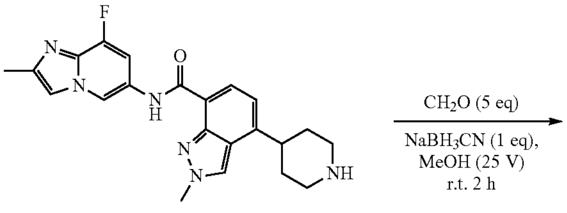

208

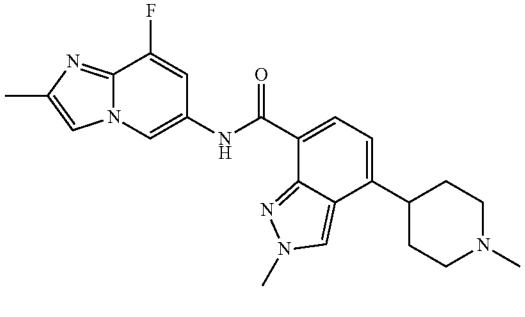

209

To a stirred solution of N-[8-fluoro-2-methylimidazo[1,2-a]pyridin-6-yl]-2-methyl-4-(piperidin-4-yl)indazole-7-carboxamide (270.0 mg, 0.66 mmol) and $CH_2O$ (99.6 mg, 3.32 mmol) in methanol (7 mL) was added $NaBH_3CN$ (41.7 mg, 0.66 mmol) dropwise at 0° C. The reaction mixture was stirred for 2 h at room temperature, then filtered, and the filter cake washed with methanol (3×5 mL). The filtrate was concentrated in vacuo and the residue purified by Prep-HPLC (Condition 2, Gradient 1) to afford N-[8-fluoro-2-methylimidazo[1,2-a]pyridin-6-yl]-2-methyl-4-(1-methylpiperidin-4-yl)indazole-7-carboxamide (7.3 mg, 2.5%) as a solid. LCMS (ES, m/z): 421 $[M+H]^+$. $^1H$ NMR (400 MHz, DMSO-$d_6$) δ 11.13 (s, 1H), 9.23 (d, J=1.7 Hz, 1H), 8.87 (s, 1H), 8.03 (d, J=7.3 Hz, 1H), 7.92 (dd, J=3.2, 1.1 Hz, 1H), 7.37 (dd, J=12.3, 1.7 Hz, 1H), 7.12 (d, J=7.4 Hz, 1H), 4.34 (s, 3H), 2.97-2.85 (m, 3H), 2.38-2.33 (m, 3H), 2.24 (s, 3H), 2.06 (dt, J=13.3, 8.4 Hz, 2H), 1.87 (dt, J=8.8, 4.1 Hz, 4H). $^{19}F$ NMR (376 MHz, DMSO) δ −132.27.

Example 18: Synthesis of Compound 210

Synthesis of Compound 210

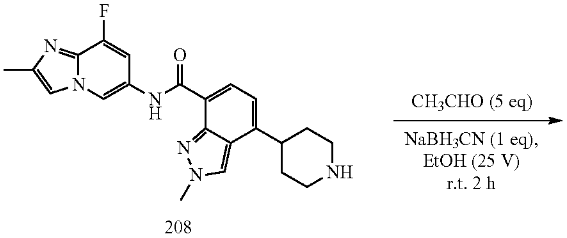

208

-continued

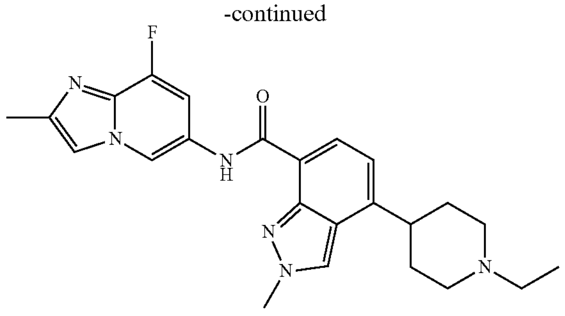

210

To a mixture solution of N-[8-fluoro-2-methylimidazo[1,2-a]pyridin-6-yl]-2-methyl-4-(piperidin-4-yl)indazole-7-carboxamide (270.0 mg, 0.66 mmol) and $CH_3CHO$ (146.1 mg, 3.32 mmol) in ethanol (7 mL) was added $NaBH_3CN$ (41.7 mg, 0.66 mmol) dropwise at 0° C. The reaction mixture was stirred for 2 h at room temperature, then filtered, and the filter cake washed with ethanol (3×5 mL). The filtrate was concentrated in vacuo and the residue purified by Prep-HPLC (Condition 2, Gradient 13) to afford 4-(1-ethylpiperidin-4-yl)-N-[8-fluoro-2-methylimidazo[1,2-a]pyridin-6-yl]-2-methylindazole-7-carboxamide (26.0 mg, 8.9%) as a solid. LCMS (ES, m/z): 435 $[M+H]^+$. $^1H$ NMR (400 MHz, DMSO-$d_6$) δ 11.13 (s, 1H), 9.25 (d, J=1.6 Hz, 1H), 8.88 (s, 1H), 8.03 (d, J=7.3 Hz, 1H), 7.93 (dd, J=3.2, 1.1 Hz, 1H), 7.37 (dd, J=12.2, 1.7 Hz, 1H), 7.13 (d, J=7.4 Hz, 1H), 4.35 (s, 3H), 3.04 (d, J=10.8 Hz, 2H), 2.94 (td, J=10.4, 9.8, 5.5 Hz, 1H), 2.41 (q, J=7.1 Hz, 2H), 2.36 (s, 3H), 2.07 (t, J=10.5 Hz, 2H), 1.93-1.77 (m, 4H), 1.05 (t, J=7.2 Hz, 3H). $^{19}F$ NMR (376 MHz, DMSO) δ −132.28.

Example 19: Synthesis of Compound 211

Synthesis of Intermediate B224

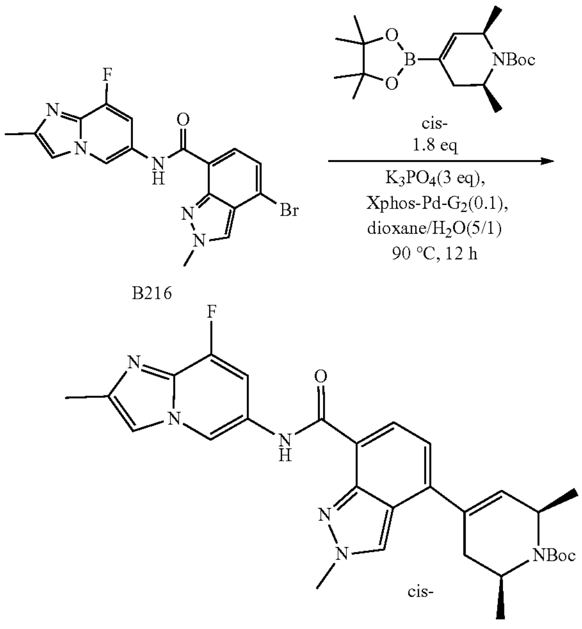

B216

B224

A mixture of 4-bromo-N-[8-fluoro-2-methylimidazo[1,2-a]pyridin-6-yl]-2-methylindazole-7-carboxamide (80.0 mg, 0.20 mmol), tert-butyl (cis-)-2,6-dimethyl-4-(4,4,5,5-tetramethyl-1,3,2-dioxaborolan-2-yl)-5,6-dihydro-2H-pyridine-1-carboxylate (120.7 mg, 0.35 mmol), $K_3PO_4$ (126.6 mg, 0.59 mmol), and XPhos palladium(II) biphenyl-2-amine chloride (15.6 mg, 0.02 mmol) in dioxane (3 mL) and $H_2O$ (0.6 mL) was stirred for 12 h at 90° C. under a $N_2$ atmosphere. The reaction mixture was diluted with $H_2O$ (20 mL) and extracted with DCM (3×20 mL). The combined organic layers were washed with saturated NaCl (1×20 mL), dried over anhydrous $Na_2SO_4$, and filtered. The filtrate was concentrated in vacuo and the residue was purified by Prep-TLC (DCM/MeOH=10/1) to afford tert-butyl (cis-)-4-[7-([8-fluoro-2-methylimidazo[1,2-a]pyridin-6-yl]carbamoyl)-2-methylindazol-4-yl]-2,6-dimethyl-5,6-dihydro-2H-pyridine-1-carboxylate (55.0 mg, 48.2%) as a solid. LCMS (ES, m/z): 533 $[M+H]^+$.

Synthesis of Intermediate B225

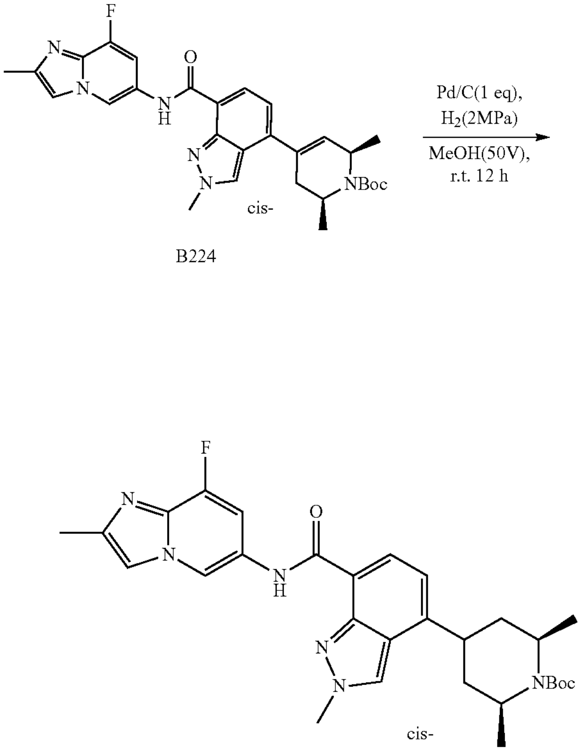

B224

B225

To a solution of tert-butyl (cis-)-4-[7-([8-fluoro-2-methylimidazo[1,2-a]pyridin-6-yl]carbamoyl)-2-methylindazol-4-yl]-2,6-dimethyl-5,6-dihydro-2H-pyridine-1-carboxylate (45.0 mg, 0.08 mmol) in methanol (2.25 mL) in a pressure tank was added Pd/C (10%, 98.9 mg). The mixture was hydrogenated at room temperature under 30 psi of hydrogen pressure for 12 h, filtered through a Celite pad and concentrated in vacuo to afford tert-butyl (cis-)-4-[7-([8-fluoro-2-methylimidazo[1,2-a]pyridin-6-yl]carbamoyl)-2-methylindazol-4-yl]-2,6-dimethylpiperidine-1-carboxylate (34.0 mg, 75.2%) as a solid. LCMS (ES, m/z): 535 $[M+H]^+$.

Synthesis of Compound 211

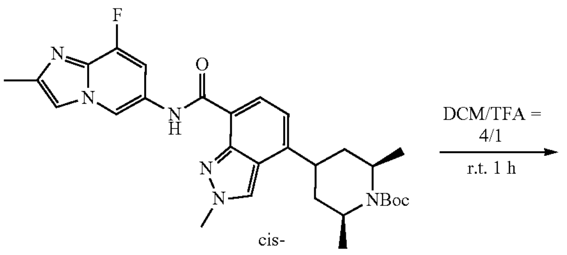

B225

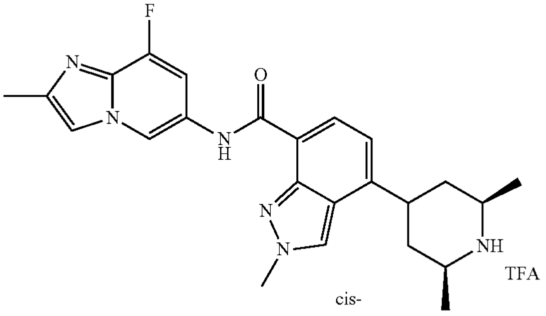

211

A solution of tert-butyl (cis-)-4-[7-([8-fluoro-2-methylimidazo[1,2-a]pyridin-6-yl]carbamoyl)-2-methylindazol-4-yl]-2,6-dimethylpiperidine-1-carboxylate (34.0 mg, 0.06 mmol) in a mixture of DCM (1.20 mL) and TFA (0.30 mL) was stirred for 1 h at room temperature. The reaction mixture was concentrated in vacuo and purified by Prep-HPLC (Condition 9, Gradient 4) to afford 4-[(cis-)-2,6-dimethylpiperidin-4-yl]-N-[8-fluoro-2-methylimidazo[1,2-a]pyridin-6-yl]-2-methylindazole-7-carboxamide trifluoroacetic acid (2.7 mg, 9.7%) as a solid. LCMS (ES, m/z): 435 $[M+H]^+$. $^1H$ NMR (400 MHz, DMSO-$d_6$) δ 11.14 (s, 1H), 9.24 (d, J=1.7 Hz, 1H), 8.87 (s, 1H), 8.05 (d, J=7.3 Hz, 1H), 7.93 (d, J=3.0 Hz, 1H), 7.38 (dd, J=12.3, 1.7 Hz, 1H), 7.09 (d, J=7.4 Hz, 1H), 4.36 (s, 3H), 3.18 (s, 1H), 2.97 (s, 2H), 2.36 (s, 3H), 1.88 (s, 2H), 1.41 (s, 2H), 1.13 (s, 6H). $^{19}F$ NMR (376 MHz, DMSO) δ −73.41, −131.86.

Example 20: Synthesis of Compound 212

Synthesis of Intermediate B226

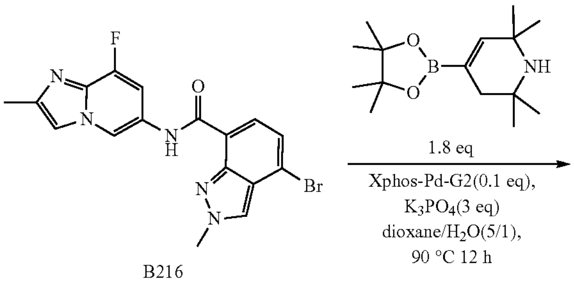

B216

-continued

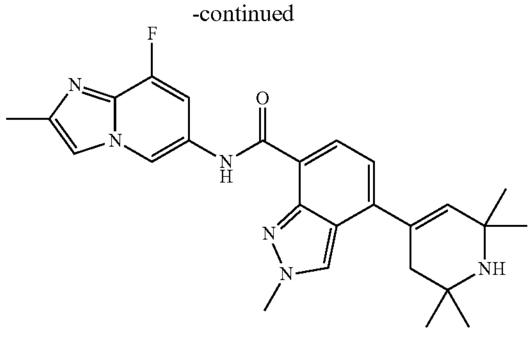

B226

A mixture of 4-bromo-N-[8-fluoro-2-methylimidazo[1,2-a]pyridin-6-yl]-2-methylindazole-7-carboxamide (80.0 mg, 0.20 mmol), 2,2,6,6-tetramethyl-4-(4,4,5,5-tetramethyl-1,3,2-dioxaborolan-2-yl)-1,3-dihydropyridine (94.9 mg, 0.35 mmol), $K_3PO_4$ (126.6 mg, 0.59 mmol), and XPhos palladium(II) biphenyl-2-amine chloride (15.6 mg, 0.02 mmol) in dioxane (3 mL) and $H_2O$ (0.6 mL) was stirred for 12 h at 90° C. under a $N_2$ atmosphere, then diluted with $H_2O$ (20 mL) and extracted with DCM (20 mL×3). The combined organic layers were washed with saturated NaCl (1×20 mL), dried over anhydrous $Na_2SO_4$, and filtered. The filtrate was concentrated in vacuo and the residue was purified by Prep-TLC (DCM/MeOH=10/1) to afford N-[8-fluoro-2-methylimidazo[1,2-a]pyridin-6-yl]-2-methyl-4-(2,2,6,6-tetramethyl-1,3-dihydropyridin-4-yl)indazole-7-carboxamide (60.0 mg, 62.8%) as a solid. LCMS (ES, m/z): 461 $[M+H]^+$.

Synthesis of Compound 212

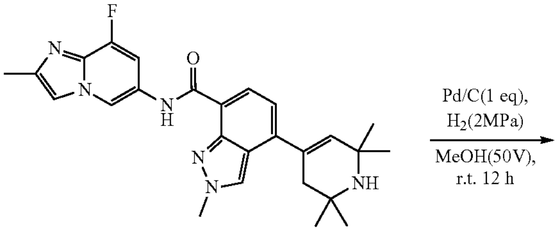

B226

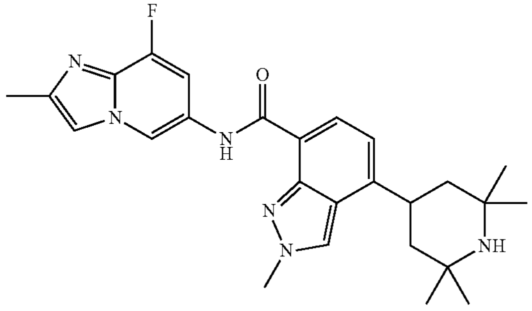

212

To a solution of N-[8-fluoro-2-methylimidazo[1,2-a]pyridin-6-yl]-2-methyl-4-(2,2,6,6-tetramethyl-1,3-dihydropyridin-4-yl)indazole-7-carboxamide (50.0 mg, 0.11 mmol) in methanol (2.5 mL) in a pressure tank was added Pd/C (10%, 115.5 mg). The reaction mixture was hydrogenated at room temperature under 20 psi of hydrogen pressure for 12 h, filtered through a Celite pad, and the filtrate concentrated in vacuo. The residue was purified by Prep-HPLC (Condition 2, Gradient 14) to afford N-[8-fluoro-2-methylimidazo[1,2-a]pyridin-6-yl]-2-methyl-4-(2,2,6,6-tetramethylpiperidin-4-yl)indazole-7-carboxamide (9.7 mg, 19.2%) as a solid. LCMS (ES, m/z): 463 $[M+H]^+$. $^1H$ NMR (400 MHz, DMSO-$d_6$) δ 11.15 (s, 1H), 9.24 (d, J=1.7 Hz, 1H), 8.85 (s, 1H), 8.05 (d, J=7.4 Hz, 1H), 7.93 (dd, J=3.2, 1.1 Hz, 1H), 7.38 (dd, J=12.3, 1.7 Hz, 1H), 7.12 (d, J=7.4 Hz, 1H), 4.37 (s, 3H), 3.48 (t, J=12.6 Hz, 1H), 2.39-2.34 (m, 3H), 1.78-1.69 (m, 2H), 1.48 (t, J=12.6 Hz, 2H), 1.32 (s, 6H), 1.11 (s, 6H). $^{19}F$ NMR (376 MHz, DMSO) δ −131.87.

Example 21: Synthesis of Compound 217

Synthesis of Intermediate B227

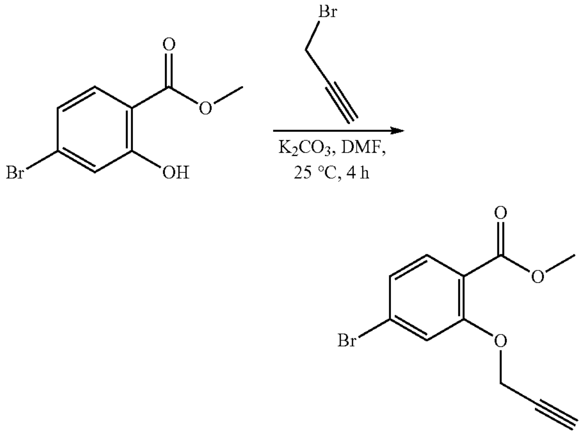

B227

A solution of methyl 1-(2-hydroxy-4-methylphenyl)acetate (30.00 g, 165.553 mmol, 1.00 equiv) and propargyl bromide (27.57 g, 0.232 mmol, 1.4 equiv) and $K_2CO_3$ (68.64 g, 0.497 mmol, 3 equiv) in DMF (300.00 mL) was stirred for 4 h at 25° C. The aqueous layer was extracted with EA and $H_2O$(1:1, 3×1 L). The resulting mixture was concentrated under reduced pressure. This resulted in methyl 1-[4-methyl-2-(prop-2-yn-1-yloxy) phenyl]acetate (23 g, 63.36%) as a solid. LCMS (ES, m/z): 268 $[M+H]^+$.

Synthesis of Intermediate B228

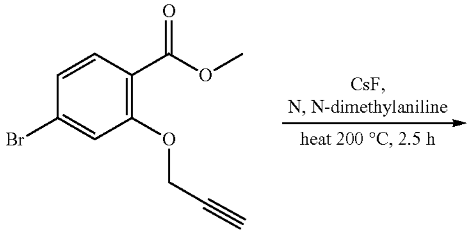

B227

-continued

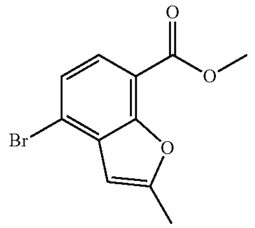

B228

A solution of methyl 1-[4-bromo-2-(prop-2-yn-1-yloxy) phenyl]acetate (1.00 g, 3.520 mmol) and CsF (0.53 mg, 0.004 mmol) in N,N-dimethylaniline (9.00 mL) was stirred for 2.5 h at 200° C. The reaction mixture was diluted with water and extracted with ethyl acetate (1:1, 3×1 L). The combined organic layers were concentrated in vacuo to afford methyl 1-(4-bromo-2-methyl-1-benzofuran-7-yl)acetate (700 mg, 70%) as a solid. LCMS (ES, m/z): 268 $[M+H]^+$.

Synthesis of Intermediate B229

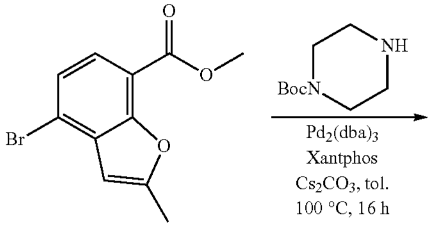

B228

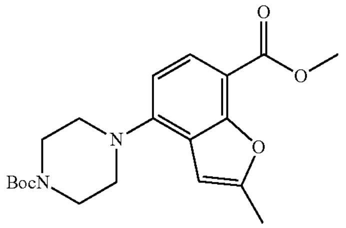

B229

To a mixture of methyl 4-bromo-2-methyl-1-benzofuran-7-carboxylate (2.00 g, 7.432 mmol) and tert-butyl piperazine-1-carboxylate (2.08 g, 11.149 mmol) in toluene (200 mL) was added Xantphos (1.290 g, 2.230 mmol), $Pd(dba)_2$ (854.72 mg, 1.486 mmol), and $Cs_2CO_3$ (7.26 g, 22.297 mmol). The reaction mixture was stirred for 16 h at 100° C. under a $N_2$ atmosphere, then allowed to cool to 25° C., diluted with water and extracted with ethyl acetate (1:1, 3×100 mL). The combined organic layers were concentrated in vacuo and the residue was purified by Prep-HPLC, eluted with EA:PE=1:3, to afford tert-butyl4-[7-(methoxycarbonyl)-2-methyl-1-benzofuran-4-yl]piperazine-1-carboxylate (1.45 g, 52.10%) as a solid. LCMS (ES, m/z): 374 $[M+H]^+$.

Synthesis of Intermediate B230

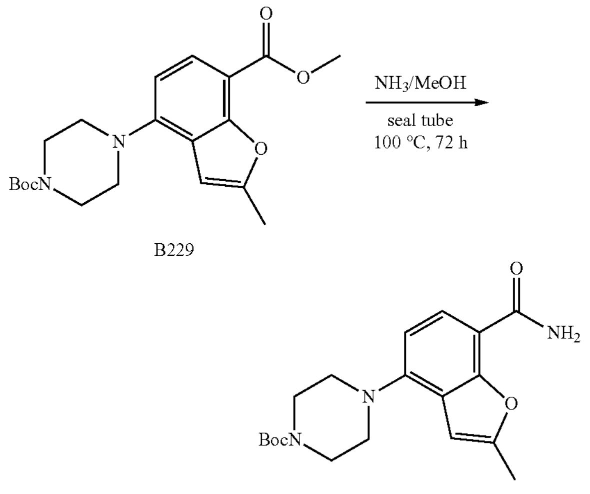

B229

B230

Tert-butyl 4-[7-(methoxycarbonyl)-2-methyl-1-benzofuran-4-yl]piperazine-1-carboxylate (1.40 g, 3.739 mmol) and $NH_3$ (191.03 mg, 11.217 mmol) were combined in methanol (150 mL) in a sealed tube. The reaction mixture was stirred for 72 h at 100° C., then concentrated in vacuo to afford tert-butyl 4-(7-carbamoyl-2-methyl-1-benzofuran-4-yl)piperazine-1-carboxylate (1.3 g, 96.74%) as a solid. LCMS (ES, m/z): 359 $[M+H]^+$.

Synthesis of Intermediate B231

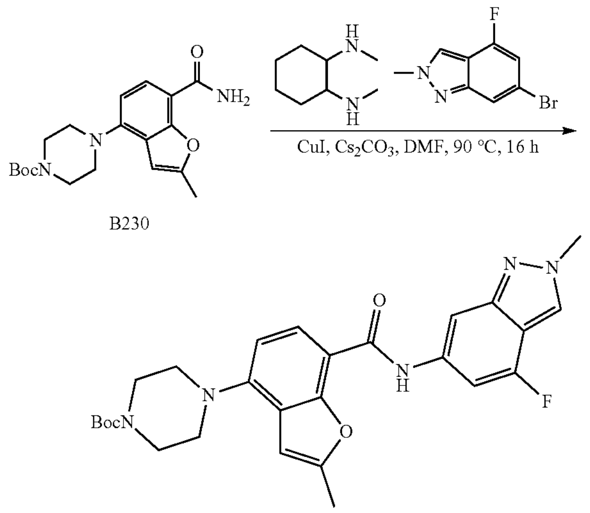

B230

B231

To a stirred solution of tert-butyl 4-(7-carbamoyl-2-methyl-1-benzofuran-4-yl)piperazine-1-carboxylate (100 mg, 0.278 mmol) and 6-bromo-4-fluoro-2-methylindazole (95.59 mg, 0.417 mmol) in DMF (10 mL) was added N1,N2-dimethylcyclohexane-1,2-diamine (7.92 mg, 0.056 mmol), CuI (21.19 mg, 0.111 mmol), and $Cs_2CO_3$ (271.95 mg, 0.834 mmol). The reaction mixture was stirred for 16 h at 90° C. under $N_2$ a atmosphere, then allowed to cool to 25° C., diluted with water, and extracted with ethyl acetate (1:1, 3×30 mL). The reaction mixture was concentrated in vacuo and the residue was purified by Prep-HPLC, eluted with PE:EA=3:1, to afford tert-butyl4-[7-[(4-fluoro-2-methylindazol-6-yl)carbamoyl]-2-methyl-1-benzofuran-4-yl]piperazine-1-carboxylate (75 mg, 53.11%) as a solid. LCMS (ES, m/z): 507 $[M+H]^+$.

Synthesis of Compound 217

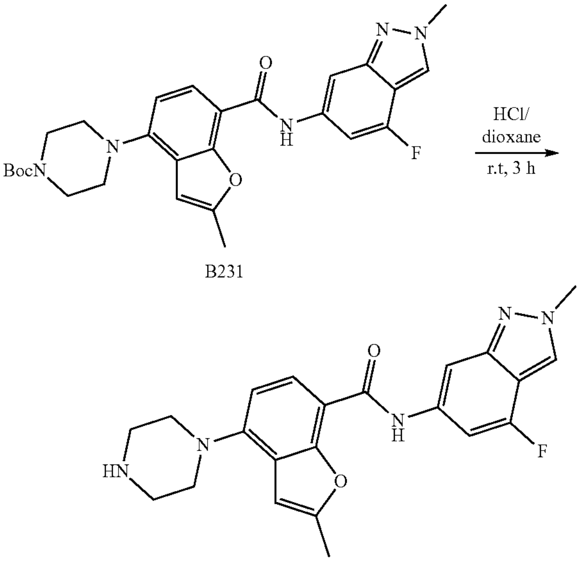

B231

217

To a stirred solution of tert-butyl4-[7-[(4-fluoro-2-methylindazol-6-yl)carbamoyl]-2-methyl-1-benzofuran-4-yl]piperazine-1-carboxylate (70.0 mg) in dioxane (9 mL) was added HCl (3 mL) dropwise at 25° C. The reaction mixture was concentrated in vacuo and the residue was purified by reverse flash chromatography (Condition 1, Gradient 1) to afford N-(4-fluoro-2-methylindazol-6-yl)-2-methyl-4-(piperazin-1-yl)-1-benzofuran-7-carboxamide (41.7 mg) as a white solid. LCMS (ES, m/z): 407 $[M+H]^+$. $^1H$ NMR (400 MHz, DMSO-$d_6$) δ 10.02 (s, 1H), 8.47 (s, 1H), 8.03 (d, J=1.4 Hz, 1H), 7.60 (d, J=8.3 Hz, 1H), 7.20 (dd, J=12.5, 1.4 Hz, 1H), 6.78-6.70 (m, 2H), 4.16 (s, 3H), 3.20-3.13 (m, 4H), 2.95-2.88 (m, 4H), 2.52 (d, J=2.3 Hz, 3H). $^{19}F$ NMR (376 MHz, DMSO-$d_6$) δ −116.97.

Example 22: Synthesis of Compound 218

Synthesis of Intermediate B232

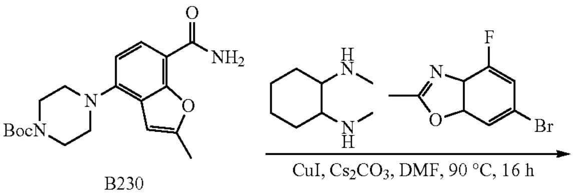

B230

-continued

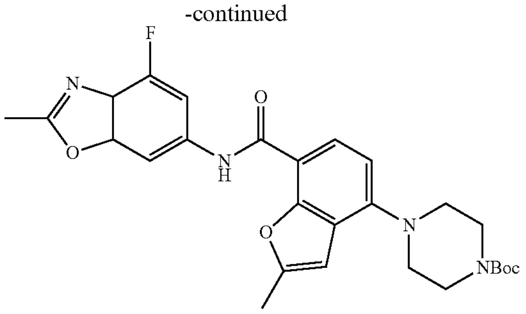

B232

To a stirred solution of tert-butyl 4-(7-carbamoyl-2-methyl-1-benzofuran-4-yl)piperazine-1-carboxylate (100 mg, 0.278 mmol) and 6-bromo-4-fluoro-2-methyl-3a,7a-dihydro-1,3-benzoxazole (96.84 mg, 0.417 mmol) in DMF (10 mL) were added N1,N2-dimethylcyclohexane-1,2-diamine (7.92 mg, 0.056 mmol), CuI (21.19 mg, 0.111 mmol), and $Cs_2CO_3$ (271.95 mg, 0.834 mmol). The reaction mixture was stirred for 16 h at 90° C. under a $N_2$ atmosphere, then allowed to cool to 25° C., diluted with water, and extracted with ethyl acetate (1:1, 3x30 mL). The combined organic layers were concentrated in vacuo and the residue was purified by Prep-HPLC, eluted with PE:EA=3:1, to afford tert-butyl 4-[7-[(4-fluoro-2-methyl-2,7a-dihydro-1,3-benzoxazol-6-yl)carbamoyl]-2-methyl-1-benzofuran-4-yl]piperazine-1-carboxylate (90 mg, 63.36%) as a solid. LCMS (ES, m/z): 510 $[M+H]^+$.

Synthesis of Compound 218

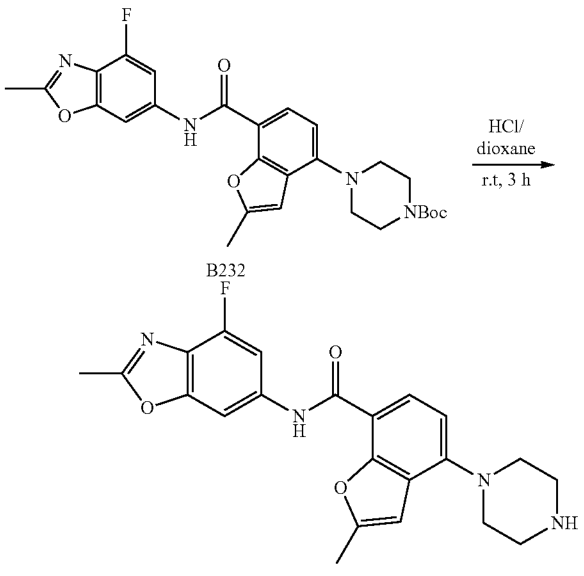

B232

218

To a stirred solution of tert-butyl 4-[7-[(4-fluoro-2-methyl-2,7a-dihydro-1,3-benzoxazol-6-yl)carbamoyl]-2-methyl-1-benzofuran-4-yl]piperazine-1-carboxylate (85 mg, 0.166 mmol) in dioxane (9 mL) was added HCl (3.00 mL, 0.044 mmol) dropwise. The reaction mixture was stirred for 3 h at 25° C., then concentrated in vacuo. The residue was purified by reverse flash chromatography (Condition 1, Gradient 1) to afford N-(4-fluoro-2-methyl-2,7a-dihydro-1,3-benzoxazol-6-yl)-2-methyl-4-(piperazin-1-yl)-1-benzofuran-7-carboxamide (25.7 mg, 37.61%) as a solid. LCMS (ES, m/z): 408 $[M+H]^+$. $^1H$ NMR (400 MHz, DMSO-$d_6$) δ 10.25 (s, 1H), 8.08 (d, J=1.6 Hz, 1H), 7.66-7.57 (m, 2H), 6.78-6.71 (m, 2H), 3.21-3.14 (m, 4H), 2.95-2.88 (m, 4H), 2.63 (s, 3H), 2.52 (s, 3H). $^{19}F$ NMR (376 MHz, DMSO-$d_6$) δ -126.16.

Example 23: Synthesis of Compound 219

Synthesis of Intermediate B233

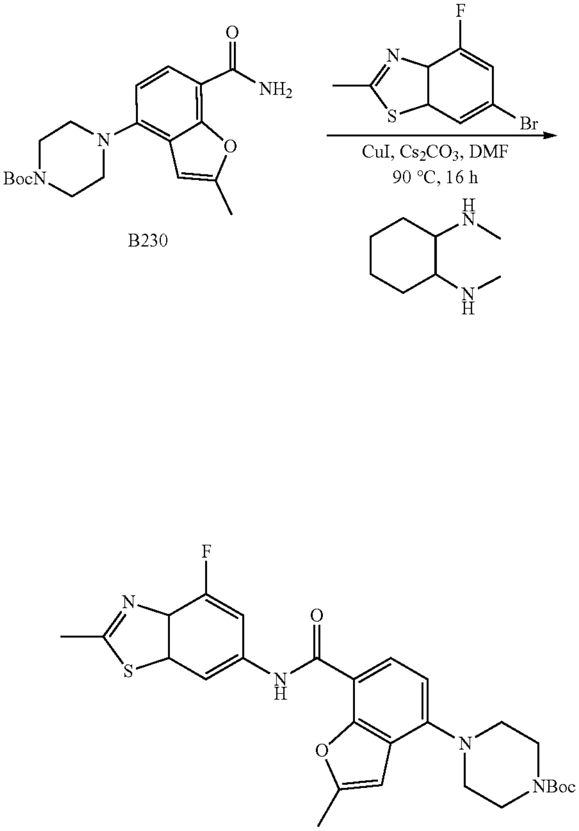

B230

B233

To a stirred solution of tert-butyl 4-(7-carbamoyl-2-methyl-1-benzofuran-4-yl)piperazine-1-carboxylate (100 mg, 0.278 mmol) and 6-bromo-4-fluoro-2-methyl-3a,7a-dihydro-1,3-benzothiazole (103.54 mg, 0.417 mmol) in DMF (10 mL) was added N1,N2-dimethylcyclohexane-1,2-diamine (7.92 mg, 0.056 mmol), CuI (21.19 mg, 0.111 mmol), and $Cs_2CO_3$ (271.95 mg, 0.834 mmol). The reaction mixture was stirred for 16 h at 90° C. under a $N_2$ atmosphere, then allowed to cool to 25° C., diluted with water, and extracted with ethyl acetate (1:1, 3x30 mL). The combined organic layers were concentrated in vacuo and the residue purified by Prep-HPLC, eluted with PE:EA=3:1, to afford tert-butyl 4-[7-[(4-fluoro-2-methyl-2,7a-dihydro-1,3-benzothiazol-6-yl)carbamoyl]-2-methyl-1-benzofuran-4-yl]piperazine-1-carboxylate (50.4 mg, 34.40%) as a solid. LCMS (ES, m/z): 526 $[M+H]^+$.

Synthesis of Compound 219

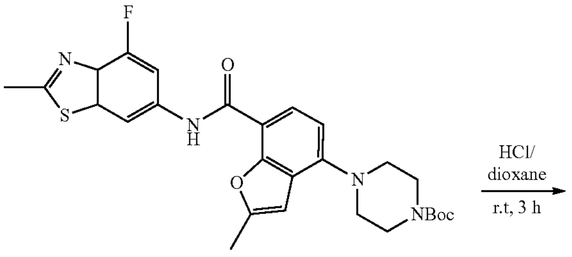

PH-RMT-2020-0457-5

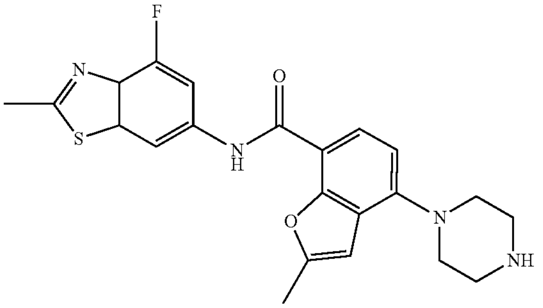

PH-RMT-2020-0457

To a stirred solution of tert-butyl 4-[7-[(4-fluoro-2-methyl-2,7a-dihydro-1,3-benzothiazol-6-yl) carbamoyl]-2-methyl-1-benzofuran-4-yl]piperazine-1-carboxylate (95 mg, 0.180 mmol) in dioxane (9 mL) was added HCl (3.00 mL, 0.044 mmol) dropwise. The reaction mixture was stirred for 3 h at 25° C., then concentrated in vacuo. The residue was purified by reverse flash chromatography (Condition 1, Gradient 1) to afford N-(4-fluoro-2-methyl-2,7a-dihydro-1,3-benzothiazol-6-yl)-2-methyl-4-(piperazin-1-yl)-1-benzofuran-7-carboxamide (50.4 mg, 65.51%) as a solid. LCMS (ES, m/z): 426 $[M+H]^+$. $^1H$ NMR (400 MHz, DMSO-$d_6$) δ 10.23 (s, 1H), 8.33 (d, J=1.9 Hz, 1H), 7.76 (dd, J=12.9, 1.9 Hz, 1H), 7.61 (d, J=8.3 Hz, 1H), 6.78-6.71 (m, 2H), 3.17 (dd, J=6.3, 3.4 Hz, 4H), 2.91 (t, J=4.9 Hz, 4H), 2.81 (s, 3H), 2.52 (s, 3H). $^{19}F$ NMR (376 MHz, DMSO-$d_6$) δ −122.33

Example 24: Synthesis of Compounds 190-195, 200-202, 205-206, and 255

Compounds 190-195, 200-202, 205-206, and 255 were prepared according to General Scheme C. The full synthesis of compound 190 is provided here as an exemplary procedure.

Synthesis of Intermediate B238

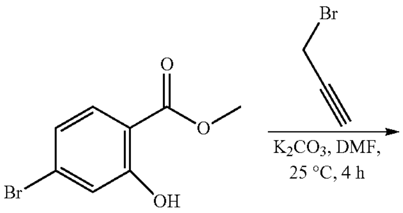

-continued

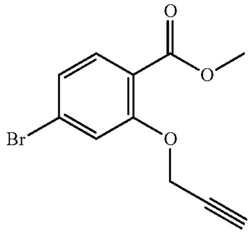

B238

A mixture of methyl 1-(2-hydroxy-4-methylphenyl)acetate (30 g, 165.553 mmol, 1.00 equiv), propargyl bromide (27.57 g, 0.232 mmol, 1.4 equiv), and $K_2CO_3$ (68.64 g, 0.497 mmol, 3 equiv) in DMF (300.00 mL) was stirred for 4 h at 25° C. The reaction mixture was partitioned between water and ethyl acetate, and the aqueous layer was extracted with EA (3×1 L). The combined organic layers were concentrated under reduced pressure to afford methyl 1-[4-methyl-2-(prop-2-yn-1-yloxy) phenyl]acetate (23 g, 63.36%) as a solid. LCMS (ES, m/z): 268 $[M+H]^+$.

Synthesis of Intermediate B239

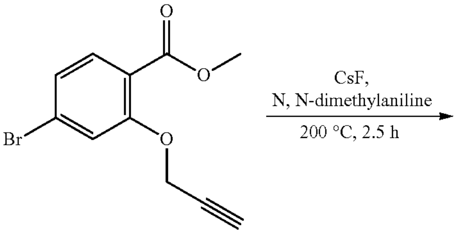

B238

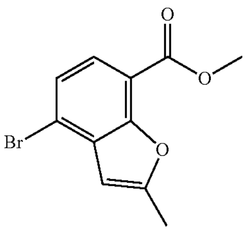

B239

A mixture of methyl 1-[4-bromo-2-(prop-2-yn-1-yloxy) phenyl]acetate (1.00 g, 3.520 mmol, 1.00 equiv) and CsF (0.53 mg, 0.004 mmol, 1 equiv) in N,N-dimethylaniline (9.00 mL) was stirred for 2.5 h at 200° C. under microwave radiation. The reaction mixture was partitioned between water and ethyl acetate, and the aqueous layer was extracted with ethyl acetate (3×1 L). The combined organic layers were concentrated under reduced pressure to afford methyl 1-(4-bromo-2-methyl-1-benzofuran-7-yl)acetate (700 mg, 70.00%) as a solid. LCMS (ES, m/z): 268 $[M+H]^+$.

Synthesis of Intermediate 240

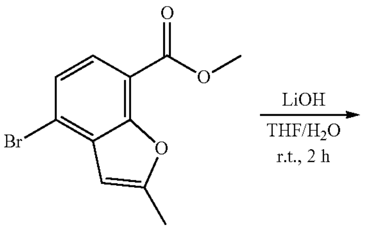

B239

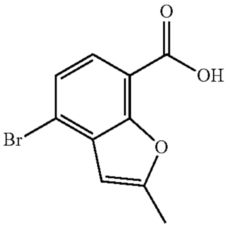

B240

To a solution of methyl 4-bromo-2-methyl-1-benzofuran-7-carboxylate (11.52 g, 42.810 mmol, 1.00 equiv) in THF (440 mL) was added LiOH (2050. mg, 0.086 mmol, 2.00 equiv) and $H_2O$ (60 mL) in portions. The reaction mixture was stirred for 2 h at 25° C., then adjusted to pH 5 with HCl (1M). The aqueous layer was extracted with ethyl acetate (3×300 mL). The combined organic layers were concentrated under vacuum to give a residue. The residue was purified by reverse flash chromatography (Column: $C_{18}$ silica gel column; Mobile Phase: acetonitrile in water (10 mmoL/L $NH_4HCO_3$); Gradient: 10% to 50% gradient in 10 min; detector, UV 254 nm) to afford 4-bromo-2-methyl-1-benzofuran-7-carboxylic acid (4.5 g, 41.21%) as a solid. LCMS (ES, m/z): 254 $[M+H]^+$.

Synthesis of Intermediate B241

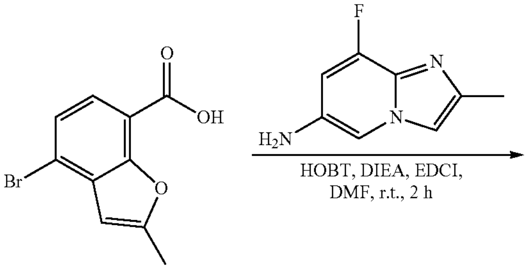

B240

-continued

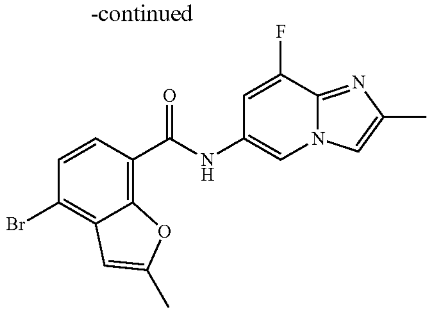

B241

To a mixture of 4-bromo-2-methyl-1-benzofuran-7-carboxylic acid (3.50 g, 13.722 mmol, 1.00 equiv) and 8-fluoro-2-methylimidazo[1,2-a]pyridin-6-amine (2719.75 mg, 0.017 mmol, 1.20 equiv) in DMF (15.00 mL) was added HOBT (2225 mg, 16.466 mmol, 1.20 equiv), EDCI (3946 mg, 20.583 mmol, 1.50 equiv), and DIEA (7094 mg, 54.888 mmol, 4.00 equiv) in portions. The reaction mixture was stirred for 2 h at 25° C., then partitioned between ethyl acetate and water. The aqueous layer was extracted with ethyl acetate (3×20 mL), and the combined organic layers concentrated under vacuum to give a residue. The residue was purified by silica gel column, eluted with DCM:MeOH (9:1), to afford 4-bromo-N-[8-fluoro-2-methylimidazo[1,2-a]pyridin-6-yl]-2-methyl-1-benzofuran-7-carboxamide (3.5 g) as a solid. LCMS (ES, m/z): 401 $[M+H]^+$.

Synthesis of Intermediate B242

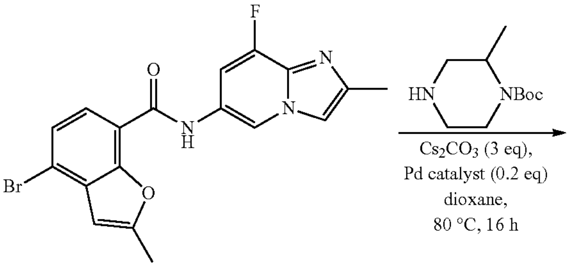

B241

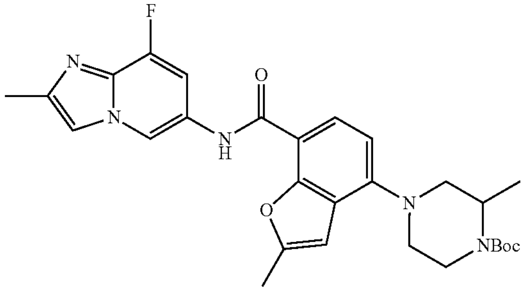

B242

To a mixture of 4-bromo-N-{8-fluoro-2-methylimidazo[1,2-a]pyridin-6-yl}-2-methyl-1-benzofuran-7-carboxamide (100 mg, 0.249 mmol, 1.00 equiv) and tert-butyl 2-methylpiperazine-1-carboxylate (74.69 mg, 0.373 mmol, 1.5 equiv) in 1,4-dioxane (5 mL) was added $Cs_2CO_3$ (243.01 mg, 0.747 mmol, 3 equiv) and Pd-PEPPSI-IPentCl 2-methylpyridine (o-picoline) (41.83 mg, 0.050 mmol, 0.2 equiv). The reaction mixture was stirred for 16 h at 100° C. under $N_2$ atmosphere, then allowed to cool to 25° C. The resulting mixture was extracted with ethyl acetate (15 mL). The combined organic layers were washed with $H_2O$ (20 mL), dried over anhydrous $Na_2SO_4$, and filtered. After filtration, the filtrate was concentrated under reduced pressure to give a residue. The residue was purified by silica gel column chromatography, eluted with PE:EA (5:1), to afford tert-butyl 4-[7-({8-fluoro-2-methylimidazo[1,2-a]pyridin-6-yl}carbamoyl)-2-methyl-1-benzofuran-4-yl]-2-methylpiperazine-1-carboxylate (75 mg, 52.05%) as a solid. LCMS (ES, m/z): 522 $[M+H]^+$.

Synthesis of Compound 190

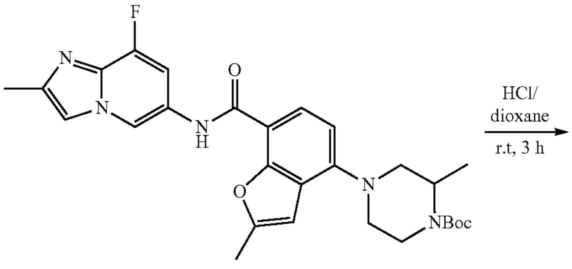

B242

-continued

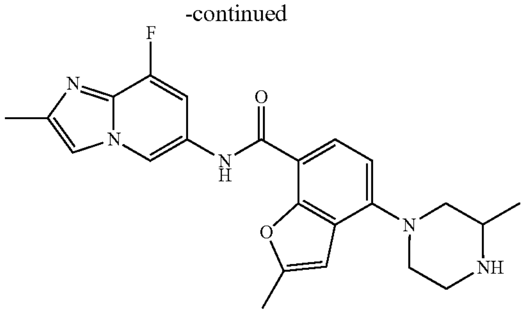

190

A mixture of tert-butyl 4-[7-({8-fluoro-2-methylimidazo[1,2-a]286yridine-6-yl}carbamoyl)-2-methyl-1-benzofuran-4-yl]-2-methylpiperazine-1-carboxylate (90 mg, 0.173 mmol, 1.00 equiv) and HCl (2 mL) in dioxane (4 mL) was stirred for 3 h at 25° C. The resulting mixture was concentrated under reduced pressure to give a residue. The residue was purified by reverse flash chromatography (Column: silica gel; Mobile Phase: acetonitrile in water (10 mmoL/L $NH_4HCO_3$); Gradient: 10% to 50% in 10 min; detector, UV 254 nm) to afford N-{8-fluoro-2-methylimidazo[1,2-a]pyridin-6-yl}-2-methyl-4-(3-methylpiperazin-1-yl)-1-benzofuran-7-carboxamide (65.3 mg, 85.30%) as a solid. LCMS: (ES, m/z): 422 $[M+H]^+$. $^1H$ NMR: (400 MHz, DMSO-$d_6$) δ 10.00 (s, 1H), 9.14 (d, J=1.6 Hz, 1H), 7.91 (dd, J=3.2, 1.0 Hz, 1H), 7.60 (d, J=8.3 Hz, 1H), 7.32 (dd, J=12.7, 1.6 Hz, 1H), 6.77-6.71 (m, 2H), 3.58-3.50 (m, 2H), 3.02-2.95 (m, 1H), 2.90 (td, J=11.8, 11.2, 2.6 Hz, 2H), 2.76 (td, J=11.3, 3.2 Hz, 1H), 2.55 (s, 3H), 2.52 (s, 1), 2.35 (d, J=0.9 Hz, 3H), 1.05 (d, J=6.3 Hz, 3H).

| Compound | A-H | LCMS (ES, m/z) $[M + H]^+$ | $^1H$ NMR (400 MHz, DMSO-$d_6$) δ |
|---|---|---|---|
| 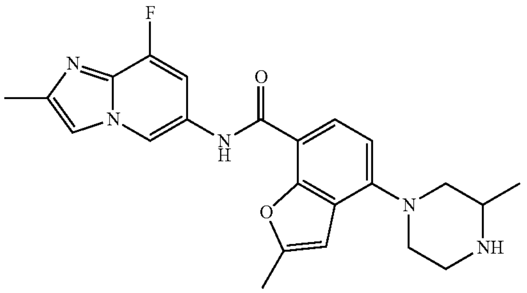 190 | 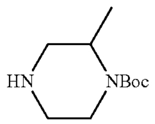 | 422 | 10.00 (s, 1H), 9.14 (d, J = 1.6 Hz, 1H), 7.91 (dd, J = 3.2, 1.0 Hz, 1H), 7.60 (d, J = 8.3 Hz, 1H), 7.32 (dd, J = 12.7, 1.6 Hz, 1H), 6.77-6.71 (m, 2H), 3.58-3.50 (m, 2H), 3.02-2.95 (m, 1H), 2.90 (td, J = 11.8, 11.2, 2.6 Hz, 2H), 2.76 (td, J = 11.3, 3.2 Hz, 1H), 2.55 (s, 3H), 2.52 (s, 1H), 2.35 (d, J = 0.9 Hz, 3H), 1.05 (d, J = 6.3 Hz, 3H) |
| 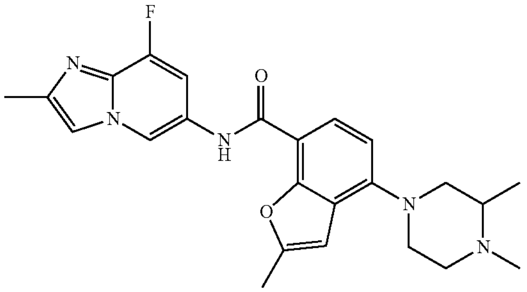 191 | 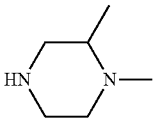 | 436 | 10.01 (s, 1H), 9.14 (d, J = 1.6 Hz, 1H), 7.91 (dd, J = 3.2, 1.1 Hz, 1H), 7.60 (d, J = 8.3 Hz, 1H), 7.32 (dd, J = 12.7, 1.6 Hz, 1H), 6.78-6.72 (m, 2H), 3.61-3.47 (m, 2H), 2.96 (td, J = 11.4, 2.8 Hz, 1H), 2.89-2.81 (m, 1H), 2.61 (dd, J = 11.9, 9.8 Hz, 1H), 2.50 (s, 3H), 2.42-2.33 (m, 4H), 2.26 (m, 4H), 1.08 (d, J = 6.2 Hz, 3H). |

-continued

| Compound | A-H | LCMS (ES, m/z) [M + H]+ | $^1$H NMR (400 MHz, DMSO-$d_6$) δ |
|---|---|---|---|
| 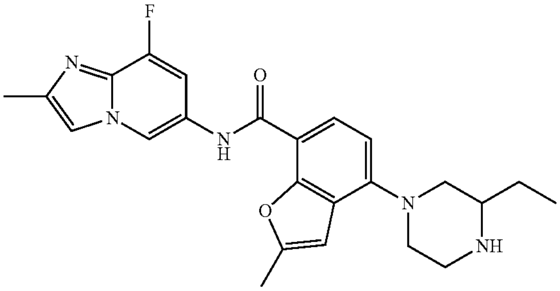 [SMILES: CCC1CN(c2ccc(C(=O)Nc3cc(F)c4nc(C)cn4c3)c3oc(C)cc23)CCN1] 192 | 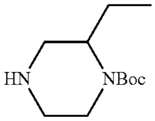 | 436 | 9.99 (s, 1H), 9.14 (d, J = 1.6 Hz, 1H), 7.91 (dd, J = 3.2, 1.0 Hz, 1H), 7.60 (d, J = 8.3 Hz, 1H), 7.32 (dd, J = 12.7, 1.6 Hz, 1H), 6.75 (d, J = 8.4 Hz, 1H), 6.70 (d, J = 1.3 Hz, 1H), 3.55 (d, J = 11.3 Hz, 2H), 3.00 (d, J = 11.9 Hz, 1H), 2.89 (t, J = 11.1 Hz, 1H), 2.83-2.73 (m, 1H), 2.70 (s, 1H), 2.53 (s, 1H), 2.52 (s, 3H), 2.35 (d, J = 0.8 Hz, 3H), 1.47-1.32 (m, 2H), 0.95 (t, J = 7.5 Hz, 3H) |
| 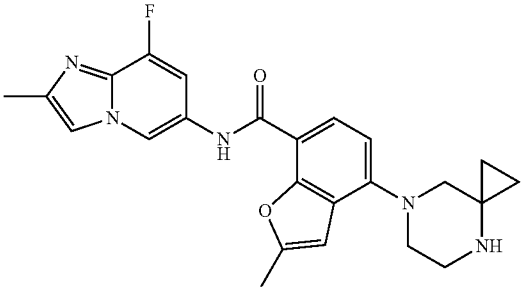 [SMILES: Cc1cn2cc(NC(=O)c3ccc(N4CCNC5(CC5)C4)c4cc(C)oc34)cc(F)c2n1] 194 | 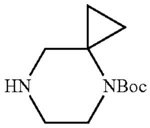 | 434 | 9.99 (s, 1H), 9.14 (d, J = 1.6 Hz, 1H), 7.91 (dd, J = 3.2, 1.0 Hz, 1H), 7.60 (d, J = 8.3 Hz, 1H), 7.32 (dd, J = 12.7, 1.6 Hz, 1H), 6.73 (d, J = 8.4 Hz, 1H), 6.66 (d, J = 1.2 Hz, 1H), 3.20 (dd, J = 6.4, 3.5 Hz, 2H), 3.07 (s, 2H), 2.96 (t, J = 4.9 Hz, 2H), 2.51 (s, 3H), 2.35 (d, J = 0.8 Hz, 3H), 0.62-0.54 (m, 2H), 0.57-0.50 (m, 2H) |
| 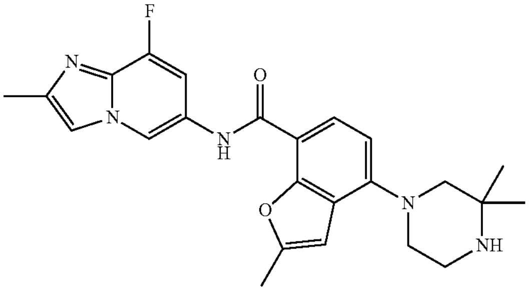 193 | 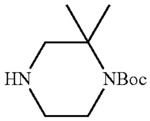 | 437 | 9.99 (s, 1H), 9.14 (d, J = 1.6 Hz, 1H), 7.91 (dd, J = 3.2, 1.0 Hz, 1H), 7.60 (d, J = 8.4 Hz, 1H), 7.32 (dd, J = 12.7, 1.7 Hz, 1H), 6.73 (d, J = 8.4 Hz, 1H), 6.66 (q, J = 1.0 Hz, 1H), 3.11 (t, J = 5.1 Hz, 2H), 2.95 (d, J = 7.5 Hz, 4H), 2.50 (s, 3H), 2.35 (d, J = 0.8 Hz, 3H), 1.19 (s, 6H) |
| 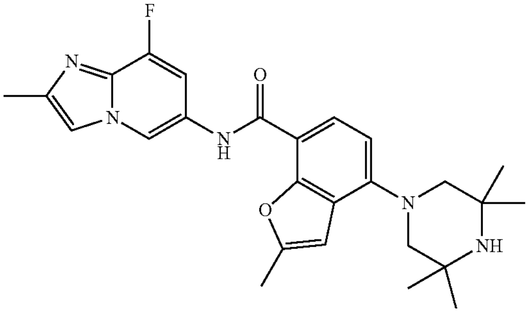 195 | 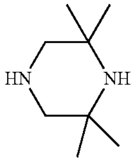 | 464 | 9.99 (s, 1H), 9.14 (d, J = 1.6 Hz, 1H), 7.91 (dd, J = 3.2, 1.0 Hz, 1H), 7.61 (d, J = 8.3 Hz, 1H), 7.32 (dd, J = 12.7, 1.6 Hz, 1H), 6.77 (d, J = 8.5 Hz, 1H), 6.63 (d, J = 1.2 Hz, 1H), 2.95 (s, 4H), 2.50 (s, 3H), 2.35 (d, J = 0.9 Hz, 3H), 1.22 (s, 12H) |

-continued
| Compound | A-H | LCMS (ES, m/z) [M + H]+ | $^{1}$H NMR (400 MHz, DMSO-$d_6$) δ |
|---|---|---|---|
| 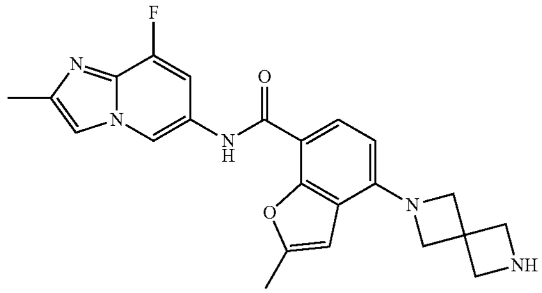 [SMILES: Cc1cn2cc(NC(=O)c3ccc(N4CC5(CNC5)C4)c4cc(C)oc34)cc(F)c2n1] 205 | 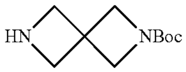 | 420 | 9.77 (s, 1H), 9.12 (d, J = 1.6 Hz, 1H), 7.89 (d, J = 3.1 Hz, 1H), 7.59 (d, J = 8.3 Hz, 1H), 7.34 (dd, J = 12.7, 1.7 Hz, 1H), 6.70 (s, 1H), 6.20 (d, J = 8.4 Hz, 1H), 4.28 (s, 1H), 4.23 (s, 4H), 4.05 (s, 1H), 3.66 (d, J = 3.1 Hz, 3H), 2.49 (d, J = 1.0 Hz, 3H), 2.35 (s, 3H) |
| 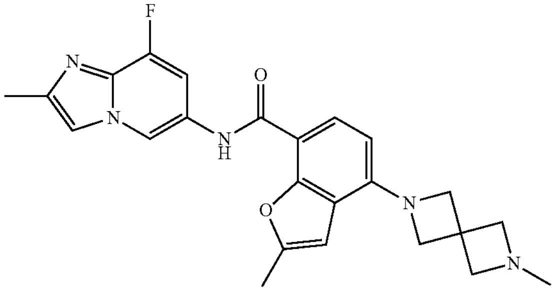 206 | 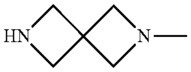 | 432 | 9.76 (s, 1H), 9.12 (d, J = 1.6 Hz, 1H), 7.92-7.86 (m, 1H), 7.58 (d, J = 8.4 Hz, 1H), 7.34 (dd, J = 12.8, 1.6 Hz, 1H), 6.69 (d, J = 1.2 Hz, 1H), 6.19 (d, J = 8.4 Hz, 1H), 4.21 (s, 4H), 2.52 (s, 3H), 2.49 (d, J = 1.1 Hz, 4H), 2.35 (d, J = 0.8 Hz, 3H), 2.21 (s, 3H) |
| 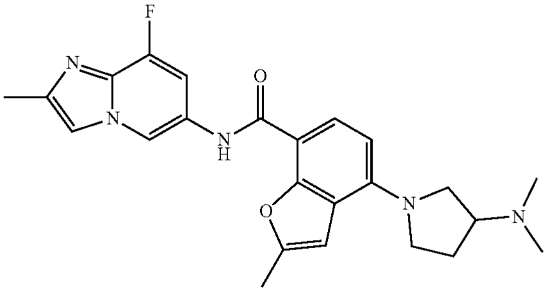 202 | 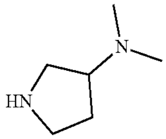 | 436 | 9.70 (s, 1H), 9.13 (d, J = 1.6 Hz, 1H), 7.89 (dd, J = 3.2, 1.0 Hz, 1H), 7.61 (d, J = 8.5 Hz, 1H), 7.36 (dd, J = 12.8, 1.6 Hz, 1H), 6.94 (d, J = 1.3 Hz, 1H), 6.36 (d, J = 8.7 Hz, 1H), 3.80-3.66 (m, 2H), 3.66-3.56 (m, 1H), 3.40 (t, J = 8.8 Hz, 1H), 2.82 (p, J = 7.5 Hz, 1H), 2.49 (d, J = 1.0 Hz, 3H), 2.35 (d, J = 0.9 Hz, 3H), 2.25 (s, 6H), 2.20 (s, 1H), 1.92-1.78 (m, 1H) |
| 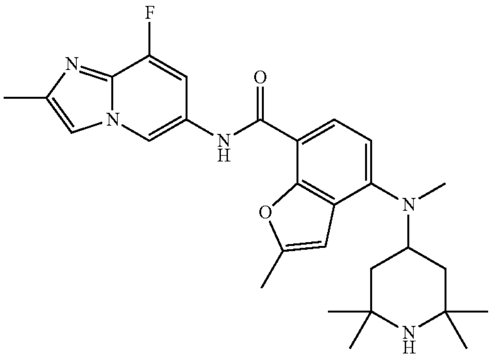 201 | 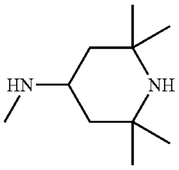 | 492 | 9.91 (s, 1H), 9.15 (d, J = 1.6 Hz, 1H), 7.91 (dd, J = 3.1, 1.0 Hz, 1H), 7.60 (d, J = 8.4 Hz, 1H), 7.33 (dd, J = 12.7, 1.7 Hz, 1H), 6.69-6.59 (m, 2H), 4.19 (d, J = 11.7 Hz, 1H), 2.86 (s, 3H), 2.50 (s, 3H), 2.35 (d, J = 0.8 Hz, 3H), 1.57 (s, 2H), 1.47 (t, J = 12.2 Hz, 2H), 1.17 (s, 6H), 1.09 (s, 6H) |

-continued

| Compound | A-H | LCMS (ES, m/z) [M + H]+ | $^1$H NMR (400 MHz, DMSO-$d_6$) δ |
|---|---|---|---|
| 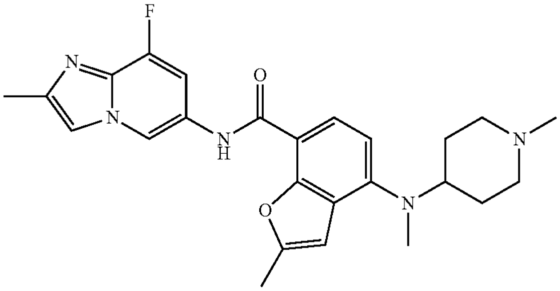 200 | 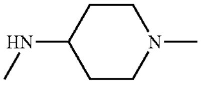 | 450 | 9.87 (s, 1H), 9.14 (d, J = 1.6 Hz, 1H), 7.90 (dd, J = 3.2, 1.0 Hz, 1H), 7.59 (d, J = 8.5 Hz, 1H), 7.33 (dd, J = 12.7, 1.6 Hz, 1H), 6.65 (d, J = 8.6 Hz, 2H), 3.68 (tt, J = 11.4, 3.8 Hz, 1H), 2.89 (s, 5H), 2.52 (s, 3H), 2.35 (d, J = 0.9 Hz, 3H), 2.19 (s, 3H), 2.04-1.97 (m, 1H), 1.96 (t, J = 11.5 Hz, 1H), 1.94-1.87 (m, 1H), 1.85 (dd, J = 12.0, 3.7 Hz, 1H), 1.65 (d, J = 11.8 Hz, 2H) |
| 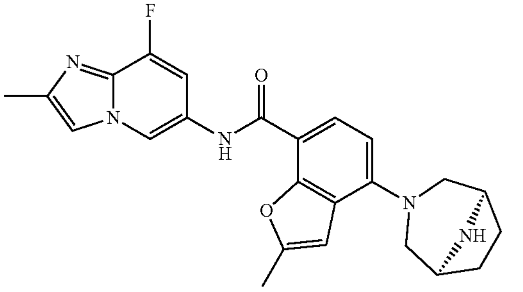 [SMILES: Cc1cn2cc(NC(=O)c3ccc(N4C[C@H]5CC[C@@H](C4)N5)c4cc(C)oc34)cc(F)c2n1] 255 | 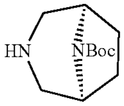 | 434 | 9.93 (s, 1H), 9.14 (d, J = 1.6 Hz, 1H), 7.90 (dd, J = 3.2, 0.9 Hz, 1H), 7.58 (d, J = 8.5 Hz, 1H), 7.32 (dd, J = 12.7, 1.6 Hz, 1H), 6.78 (d, J = 1.2 Hz, 1H), 6.65 (d, J = 8.5 Hz, 1H), 3.49 (d, J = 9.8 Hz, 4H), 2.99 (d, J = 9.9 Hz, 2H), 2.50 (s, 3H), 2.35 (d, J = 0.8 Hz, 3H), 1.84 (q, J = 6.6, 5.8 Hz, 2H), 1.72 (s, 2H) |

Example 25: Synthesis of Compounds 261

Synthesis of Intermediate B243

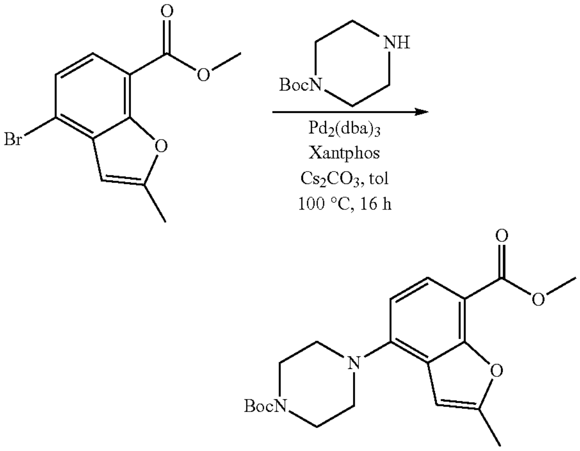

B243

To a mixture of methyl 4-bromo-2-methyl-1-benzofuran-7-carboxylate (2.00 g, 7.432 mmol, 1.00 equiv) and tert-butyl piperazine-1-carboxylate (2076 mg, 11.149 mmol, 1.50 equiv) in toluene (200 mL) was added Xantphos (1290 mg, 2.230 mmol, 0.30 equiv), $Pd(dba)_2$ (854.7 mg, 1.486 mmol, 0.20 equiv), and $Cs_2CO_3$ (7264.8 mg, 22.297 mmol, 3.00 equiv). The reaction mixture was stirred for 16 h at 100° C. under $N_2$ atmosphere, then allowed to cool to 25° C. and partitioned between water and ethyl acetate. The aqueous layer was extracted with ethyl acetate (3×100 mL). The combined organic layers were concentrated under reduced pressure to give a residue. The residue was purified by silica gel chromatography, eluted with EA:PE (1:3), to afford tert-butyl 4-[7-(methoxycarbonyl)-2-methyl-1-benzofuran-4-yl]piperazine-1-carboxylate (1.45 g, 52.10%) as a solid. LCMS (ES, m/z): 374 [M+H]+.

Synthesis of Intermediate B244

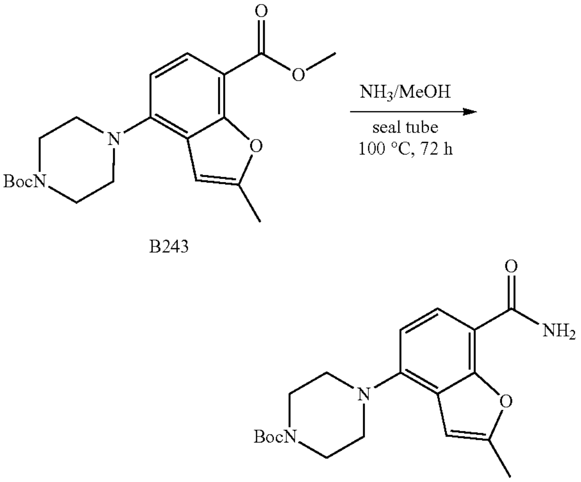

B243

B244

Tert-butyl 4-[7-(methoxycarbonyl)-2-meth yl-1-benzofuran-4-yl]piperazine-1-carboxylate (1.40 g, 3.739 mmol, 1.00 equiv) and $NH_3$ (191.03 mg, 11.217 mmol, 3.00 equiv) were combined in MeOH (150.00 mL) in a sealed tube. The reaction mixture was stirred for 72 h at 100° C., then concentrated under reduced pressure to afford tert-butyl 4-(7-carbamoyl-2-methyl-1-benzofuran-4-yl) piperazine-1-carboxylate (1.3 g, 96.74%) as a solid. LCMS (ES, m/z): 359 $[M+H]^+$.

Synthesis of Intermediate B245

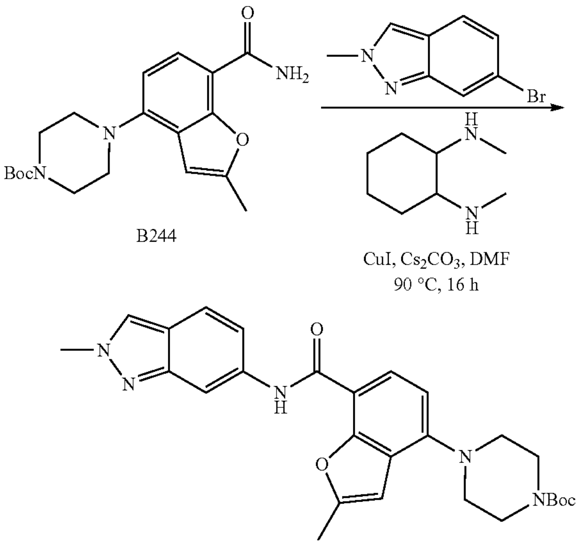

B244

B245

To a mixture of tert-butyl 4-(7-carbamoyl-2-methyl-1-benzofuran-4-yl)piperazine-1-carboxylate (100 mg, 0.278 mmol, 1.00 equiv) and 6-bromo-2-methylindazole (88.08 mg, 0.417 mmol, 1.5 equiv) in DMF (10 mL) was added N1,N2-dimethylcyclohexane-1,2-diamine (15.83 mg, 0.111 mmol, 0.4 equiv), $Cs_2CO_3$ (271.95 mg, 0.834 mmol, 3 equiv), and CuI (15.90 mg, 0.083 mmol, 0.3 equiv). The reaction mixture was stirred for 16 h at 90° C. under $N_2$ atmosphere, then allowed to cool to 25° C. The resulting mixture was extracted with ethyl acetate (15 mL). The organic layer was washed with $H_2O$ (3×20 mL), dried over anhydrous $Na_2SO_4$, and filtered. After filtration, the filtrate was concentrated under reduced pressure to give a residue. The residue was purified by Prep-HPLC, eluted with PE:EA (3:1), to afford tert-butyl 4-{2-methyl-7-[(2-methylindazol-6-yl)carbamoyl]-1-benzofuran-4-yl}piperazine-1-carboxylate (60 mg, 41.85%) as a solid. LCMS (ES, m/z): 490 $[M+H]^+$.

Synthesis of Compound 261

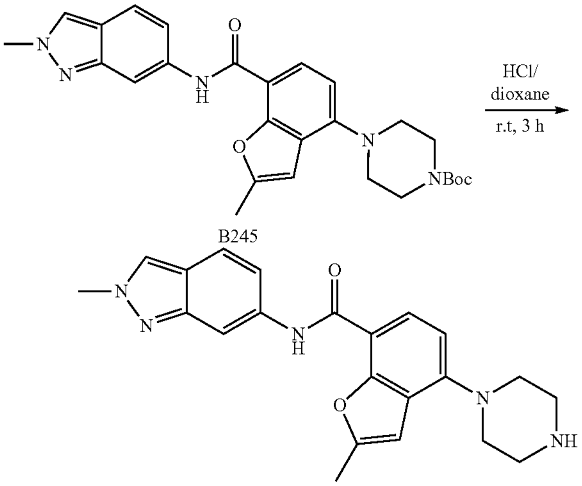

B245

261

A mixture of tert-butyl 4-{2-methyl-7-[(2-methylindazol-6-yl)carbamoyl]-1-benzofuran-4-yl}piperazine-1-carboxylate (110 mg, 0.225 mmol, 1.00 equiv) and HCl (5.5 mL) in dioxane (11.0 mL) was stirred for 3 h at 25° C., then concentrated under reduced pressure to give a residue. The residue was purified by reverse flash chromatography (Column: silica gel; Mobile Phase: acetonitrile in water (10 mmoL/L $NH_4HCO_3$): Gradient: 10% to 50% in 10 min; detector, UV 254 nm) to afford 2-methyl-N-(2-methylindazol-6-yl)-4-(piperazin-1-yl)-1-benzofuran-7-carboxamide (67 mg, 76.57%) as a solid. LCMS: (ES, W/z): $390[M+H]^+$. $^1H$ NMR: $^1H$ NMR (400 MHz, DMSO-$d_6$) δ9.91 (s, 1H), 8.25 (d, J=15.1 Hz, 2H), 7.64 (dd, J=15.3, 8.6 Hz, 2H), 7.26 (dd, J=8.9, 1.8 Hz, 1H), 6.78-6.65 (m, 2H), 4.14 (s, 3H), 3.16 (dd, J=6.2, 3.5 Hz, 4H), 2.91 (dd, J=6.0, 3.5 Hz, 4H), 2.52 (s, 3H).

Compounds 261-268 were prepared according to General Scheme D and the general protocol outlined above for Compound 261, with specific details outlined in the table below.

| Compound | B-Br | LCMS (ES, m/z) $[M + H]^+$ | $^1H$ NMR (400 MHz, DMSO-$d_6$) δ |
|---|---|---|---|
| 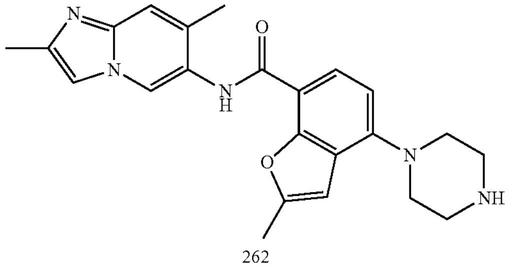 262 | 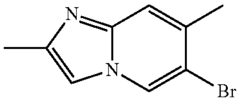 | 404 | 9.41 (s, 1H), 9.09 (s, 1H), 7.74 (d, J = 8.4 Hz, 1H), 7.68 (s, 1H), 7.37 (s, 1H), 6.81-6.75 (m, 2H), 3.19 (s, 4H), 2.91 (s, 4H), 2.53 (s, 3H), 2.46 (s, 3H), 2.31 (s, 3H) |

-continued
| Compound | B-Br | LCMS (ES, m/z) $[M + H]^+$ | $^1H$ NMR (400 MHz, DMSO-$d_6$) δ |
| --- | --- | --- | --- |
| 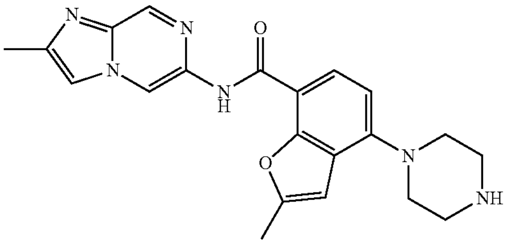 [SMILES: Cc1cn2cc(NC(=O)c3ccc(N4CCNCC4)c4cc(C)oc34)ncc2n1] 263 | 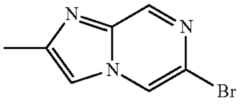 | 390 | 9.93 (s, 1H), 9.41 (d, J = 1.4 Hz, 1H), 8.85 (d, J = 1.5 Hz, 1H), 8.06 (s, 1H), 7.78 (d, J = 8.5 Hz, 1H), 6.82-6.75 (m, 2H), 3.20 (dd, J = 6.5, 3.3 Hz, 4H), 2.90 (dd, J = 5.8, 3.6 Hz, 4H), 2.55 (d, J = 1.0 Hz, 3H), 2.42 (s, 3H) |
| 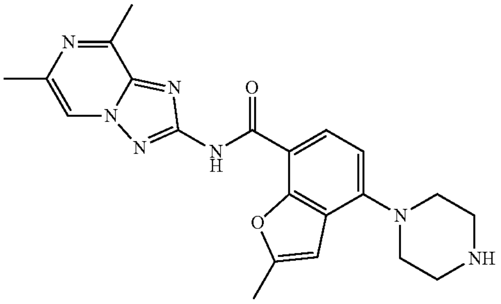 [SMILES: Cc1cn2nc(NC(=O)c3ccc(N4CCNCC4)c4cc(C)oc34)nc2c(C)n1] 264 | 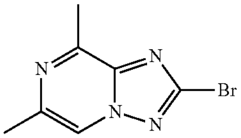 | 406 | 10.70 (s, 1H), 8.74 (s, 1H), 7.68 (d, J = 8.3 Hz, 1H), 6.78-6.69 (m, 2H), 3.22 (dd, J = 6.3, 3.5 Hz, 4H), 2.96 (dd, J = 6.1, 3.7 Hz, 4H), 2.76 (s, 3H), 2.52 (s, 3H), 2.50 (s, 3H) |
| 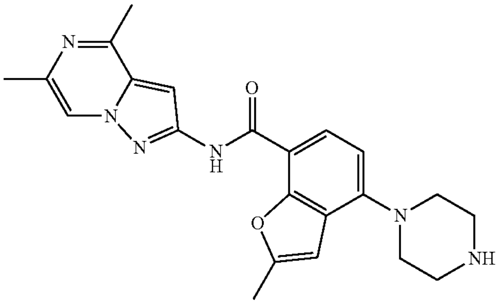 [SMILES: Cc1cn2nc(NC(=O)c3ccc(N4CCNCC4)c4cc(C)oc34)cc2c(C)n1] 265 | 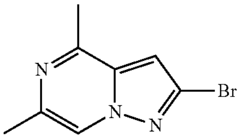 | 405 | 10.49 (s, 1H), 8.41-8.36 (m, 1H), 7.73 (d, J = 8.4 Hz, 1H), 7.26 (d, J = 1.0 Hz, 1H), 6.75 (dd, J = 4.8, 3.7 Hz, 2H), 3.19 (t, J = 4.6 Hz, 4H), 2.91 (d, J = 4.9 Hz, 4H), 2.67 (s, 3H), 2.53 (d, J = 1.0 Hz, 3H), 2.41 (d, J = 1.0 Hz, 3H) |
| 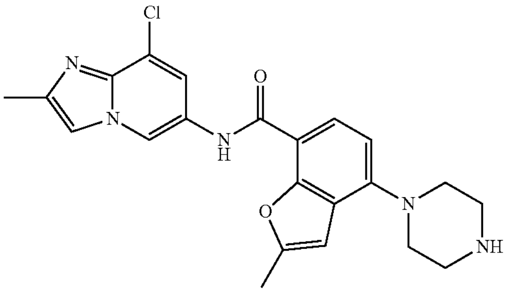 266 | 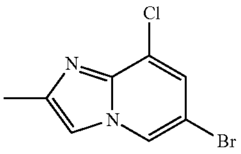 | 424 | 10.00 (s, 1H), 9.26 (d, J = 1.7 Hz, 1H), 7.91 (d, J = 1.0 Hz, 1H), 7.64-7.57 (m, 2H), 6.78-6.71 (m, 2H), 3.30 (s, 4H), 3.17 (d, J = 5.0 Hz, 4H), 2.90 (s, J = 4.9 Hz, 3H), 2.36 (d, J = 0.8 Hz, 3H) |
| 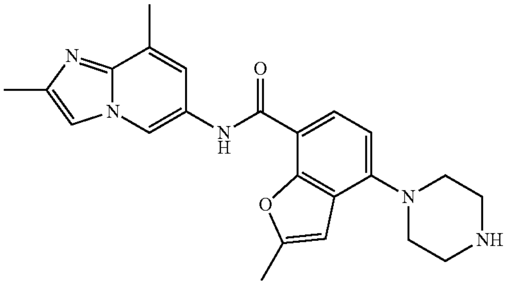 [SMILES: Cc1cn2cc(NC(=O)c3ccc(N4CCNCC4)c4cc(C)oc34)cc(C)c2n1] 267 | 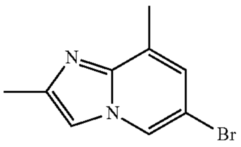 | 404 | 9.85 (s, 1H), 9.10 (d, J = 2.0 Hz, 1H), 7.73 (d, J = 1.0 Hz, 1H), 7.61 (d, J = 8.3 Hz, 1H), 7.15 (dd, J = 2.0, 1.1 Hz, 1H), 6.77-6.70 (m, 2H), 3.16 (dd, J = 6.3, 3.5 Hz, 4H), 2.90 (t, J = 4.8 Hz, 4H), 2.52 (s, 3H), 2.46 (t, J = 0.9 Hz, 3H), 2.33 (d, J = 0.9 Hz, 3H) |

-continued

| Compound | B-Br | LCMS (ES, m/z) $[M + H]^+$ | $^1H$ NMR (400 MHz, DMSO-$d_6$) δ |
|---|---|---|---|
| 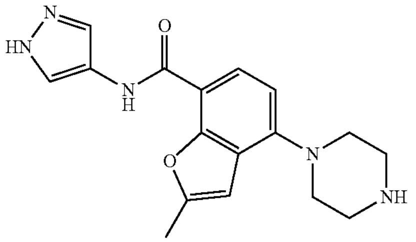 [SMILES: Cc1cc2c(N3CCNCC3)ccc(C(=O)Nc3cn[nH]c3)c2o1] 268 | 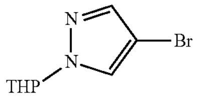 | 326 | 9.92 (s, 1H), 7.86 (s, 2H), 7.58 (d, J = 8.3 Hz, 1H), 6.71 (d, J = 8.3 Hz, 2H), 3.14 (t, J = 4.7 Hz, 4H), 2.90 (t, J = 4.8 Hz, 4H), 2.52 (s, 3H) |

Example 26: Synthesis of Compound 143

Synthesis of Intermediate B246

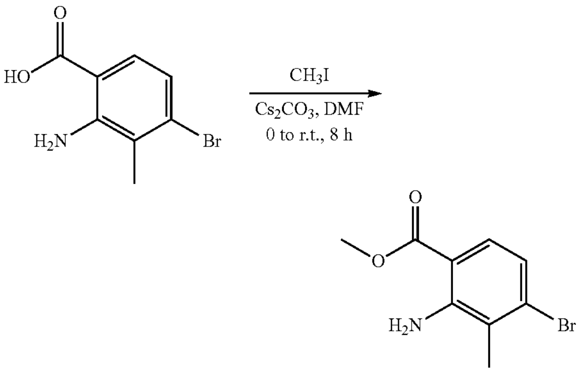

B246

To a mixture of 2-amino-4-bromo-3-methylbenzoic acid (10.00 g, 43.467 mmol, 1.00 equiv) and $Cs_2CO_3$ (21.24 g, 65.201 mmol, 1.50 equiv) in DMF (100 mL) was added methyl iodide (7.40 g, 52.160 mmol, 1.20 equiv) dropwise at 0° C. under nitrogen atmosphere. The reaction mixture was stirred for 8 h at room temperature under nitrogen atmosphere, then quenched with water. The resulting mixture was extracted with ethyl acetate (3×100 mL), dried over anhydrous $Na_2SO_4$, and filtered. After filtration, the filtrate was concentrated under reduced pressure to afford methyl 2-amino-4-bromo-3-methylbenzoate (10 g, 94.25%) as a solid. LCMS (ES, m/z): 244 $[M+H]^+$.

Synthesis of Intermediate B247

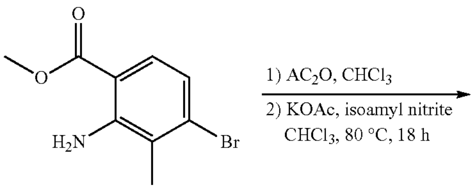

B246

-continued

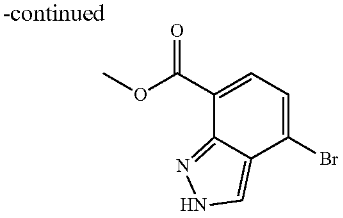

B247

To a mixture of methyl 2-amino-4-bromo-3-methylbenzoate (10.00 g, 40.969 mmol, 1.00 equiv) and $AC_2O$ in chloroform (100 mL) was added KOAC and isoamyl nitrite in portions over 1 h at room temperature under nitrogen atmosphere. The reaction mixture was stirred for an additional 18 h at 80° C. The resulting mixture was extracted with dichloromethane (3×100 mL), dried over anhydrous $Na_2SO_4$, and filtered. After filtration, the filtrate was concentrated under reduced pressure to afford methyl 4-bromo-2H-indazole-7-carboxylate (9.1 g, 87.08%) as a solid. LCMS (ES, m/z): $254[M+H]^+$.

Synthesis of Intermediate B248

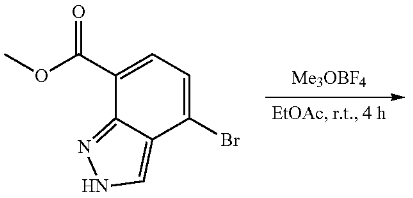

B247

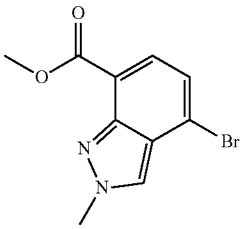

B248

A mixture of methyl 4-bromo-2H-indazole-7-carboxylate (2.00 g) and $Me_3OBF_4$ (2.10 g, 1.30 equiv) in ethyl acetate (20 mL) was stirred at room temperature for 4 h under nitrogen atmosphere. The reaction mixture was basified to pH 8 with saturated $NaHCO_3$ aqueous, then resulting mixture was extracted with ethyl acetate (3×50 mL), dried over anhydrous $Na_2SO_4$, and filtered. After filtration, the filtrate was concentrated under reduced pressure to afford methyl 4-bromo-2-methylindazole-7-carboxylate (1.9 g, 90.04%) as a solid. LCMS (ES, m/z): 269 $[M+H]^+$.

Synthesis of Intermediate B249

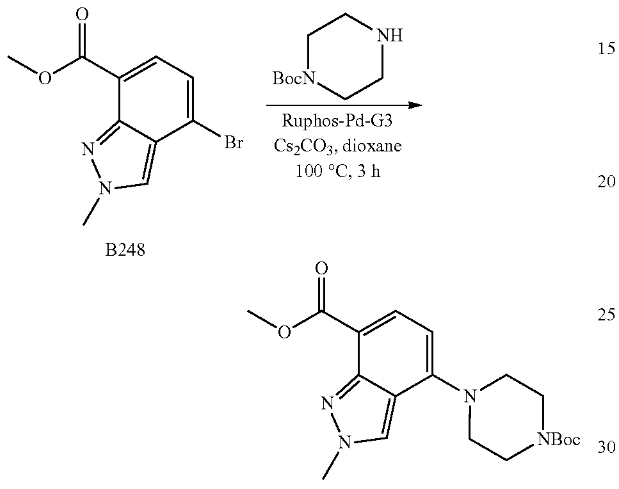

B248

B249

To a mixture of methyl 4-bromo-2-methylindazole-7-carboxylate (1.80 g, 6.689 mmol, 1.00 equiv) and tert-butyl piperazine-1-carboxylate (1.50 g, 8.027 mmol, 1.20 equiv) in 1,4-dioxane was added RuPhos Palladacycle Gen.3 (0.56 g, 0.669 mmol, 0.10 equiv) and $Cs_2CO_3$ (6.54 g, 20.067 mmol, 3.00 equiv) in portions at room temperature under nitrogen atmosphere. The reaction mixture was stirred overnight at 100° C. under nitrogen atmosphere. The resulting mixture was quenched with water and extracted with ethyl acetate (3×50 mL), washed with saturated NaCl (1×50 mL). The organic layers were combined, dried over anhydrous $Na_2SO_4$, and filtered. After filtration, the filtrate was concentrated under reduced pressure to give a residue. The residue was purified by silica gel column chromatography, eluted with PE/EA (1:1), to afford methyl 4-[4-(tert-butoxycarbonyl) piperazin-1-yl]-2-methylindazole-7-carboxylate (1.2 g, 47.91%) as a solid. LCMS (ES, m/z): 375 $[M+H]^+$.

Synthesis of Intermediate B250

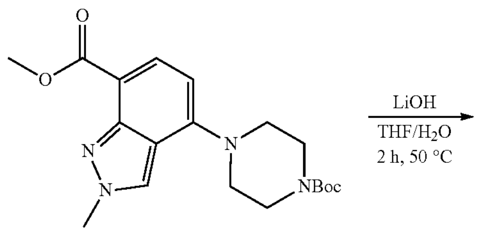

B249

-continued

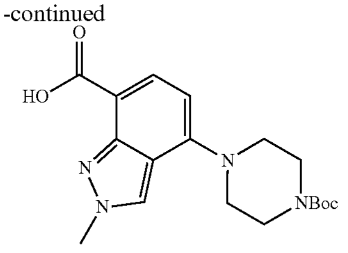

B250

To methyl 4-[4-(tert-butoxycarbonyl) piperazin-1-yl]-2-methylindazole-7-carboxylate (200.00 mg, 0.534 mmol, 1.00 equiv) in a mixture of THF (2 mL) and $H_2O$ (2 mL) was added LiOH (0.05 g, 2.136 mmol, 4.00 equiv). The reaction mixture was stirred for 2 h at 50° C. under nitrogen atmosphere. The resulting mixture was adjusted to pH 4 with 1 N HCl, extracted with ethyl acetate (3×10 mL), dried over anhydrous $Na_2SO_4$, and filtered. After filtration, the filtrate was concentrated under reduced pressure to afford 4-[4-(tert-butoxycarbonyl)piperazin-1-yl]-2-methylindazole-7-carboxylic acid (190 mg, 98.70%) as a solid. LCMS (ES, m/z): 361 $[M+H]^+$.

Synthesis of Intermediate B251

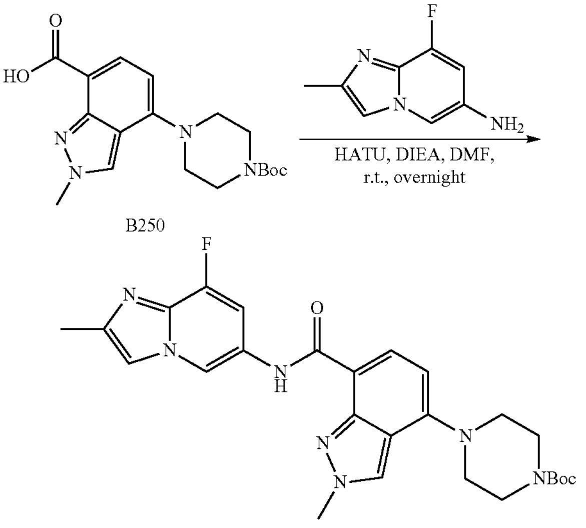

B250

B251

To a mixture of 4-[4-(tert-butoxycarbonyl)piperazin-1-yl]-2-methylindazole-7-carboxylic acid (170 mg, 0.472 mmol, 1.00 equiv) and 8-fluoro-2-methylimidazo[1,2-a] pyridin-6-amine (93.49 mg, 0.000 mmol, 1.20 equiv) in DMF (2 mL) was added HATU (269.02 mg, 0.708 mmol, 1.50 equiv) and DIEA (300.02 mg, 0.708 mmol, 3.00 equiv) in portions at room temperature under nitrogen atmosphere. The reaction mixture was stirred for overnight, then quenched with water (10 mL), extracted with ethyl acetate (3×10 mL), dried over anhydrous $Na_2SO_4$, and filtered. After filtration, the filtrate was concentrated under reduced pressure to afford tert-butyl 4-[7-([8-fluoro-2-methylimidazo[1,2-a]pyridin-6-yl]carbamoyl)-2-methylindazol-4-yl]piperazine-1-carboxylate (201 mg, 83.96%) as a solid. LCMS (ES, m/z): 508$[M+H]^+$.

Synthesis of Compound 143

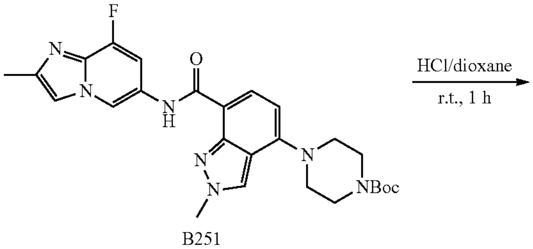

B251

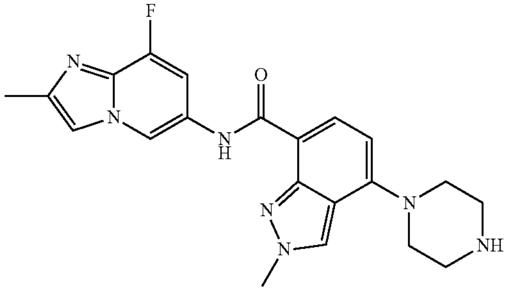

143

A mixture of tert-butyl 4-[7-([8-fluoro-2-methylimidazo[1,2-a]pyridin-6-yl]carbamoyl)-2-methylindazol-4-yl]piperazine-1-carboxylate (201 mg) and HCl (gas)/dioxane in 1,4-dioxane (2 mL) was stirred for 1 h at room temperature under nitrogen atmosphere. The resulting mixture was concentrated under reduced pressure to give a residue. The residue was purified by Prep-HPLC (Condition 2, Gradient 15) to afford N-[8-fluoro-2-methylimidazo[1,2-a]pyridin-6-yl]-2-methyl-4-(piperazin-1-yl) indazole-7-carboxamide (42.2 mg) as a solid. LCMS (ES, m/z): 408$[M+H]^+$. $^1H$ NMR (400 MHz, DMSO-$d_6$) δ 11.07 (s, 1H), 9.22 (d, J=1.7 Hz, 1H), 8.88 (s, 1H), 8.01 (d, J=8.0 Hz, 1H), 7.91 (d, J=3.1 Hz, 1H), 7.36 (dd, J=12.4, 1.7 Hz, 1H), 6.58 (d, J=8.1 Hz, 1H), 4.32 (s, 3H), 3.54 (dd, J=6.8, 3.6 Hz, 4H), 3.22 (dd, J=6.4, 3.6 Hz, 4H), 2.36 (s, 3H).

Example 27: Synthesis of Compound 145

Synthesis of Intermediate B252

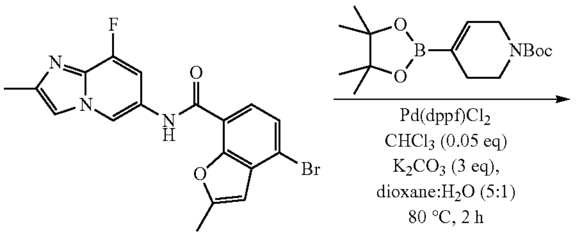

B222

-continued

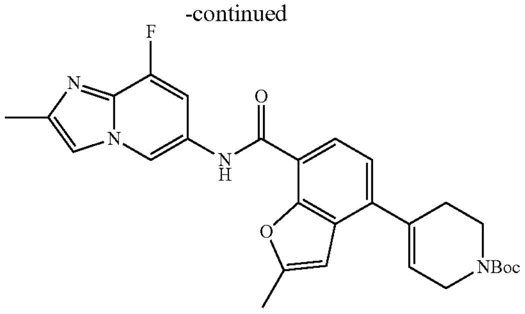

B252

To a mixture of 4-bromo-N-[8-fluoro-2-methylimidazo[1,2-a]pyridine-6-yl]-2-methyl-1-benzofuran-7-carboxamide (200.00 mg, 0.497 mmol, 1.00 equiv) and tert-butyl 4-(4,4,5,5-tetramethyl-1,3,2-dioxaborolan-2-yl)-3,6-dihydro-2H-pyridine-1-carboxylate (153.75 mg, 0.497 mmol, 1 equiv) in 1,4-dioxane (20 ml) and water (4 ml) was added Pd(dppf)$Cl_2$ (40.51 mg, 0.050 mmol, 0.1 equiv) and $K_2CO_3$ (206.16 mg, 1.492 mmol, 3.00 equiv). The reaction mixture was stirred for 2 h at 80° C. under a nitrogen atmosphere, then quenched with water at room temperature. The resulting mixture was extracted with DCM (3×20 mL). The combined organic layers were washed with brine (2×10 mL), dried over anhydrous $Na_2SO_4$, and filtered. After filtration, the filtrate was concentrated under reduced pressure to give a residue. The residue was purified by Prep-TLC/silica gel column chromatography, eluted with DCM/MeOH (10:1), to afford tert-butyl 4-[7-([8-fluoro-2-methylimidazo[1,2-a]pyridin-6-yl]carbamoyl)-2-methyl-1-benzofuran-4-yl]-3,6-dihydro-2H-pyridine-1-carboxylate (160 mg, 63.77%) as a solid. LCMS (ES, m/z): 505 $[M+H]^+$.

Synthesis of Intermediate B253

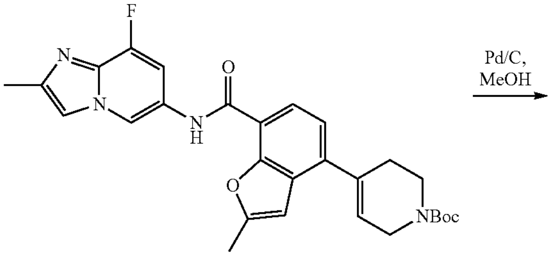

B252

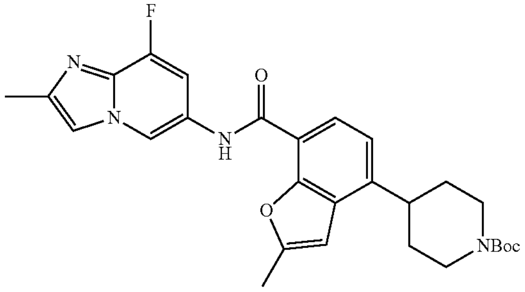

B253

To a solution of tert-butyl 4-[7-([8-fluoro-2-methylimidazo[1,2-a]pyridine-6-yl]carbamoyl)-2-methyl-1-benzofuran-4-yl]-3,6-dihydro-2H-pyridine-1-carboxylate (150 mg) in methanol (15 mL) was added Pd/C (10%, 15 mg) under nitrogen atmosphere in a 100 mL sealed tube. The reaction mixture was hydrogenated at room temperature for 6 h under a hydrogen atmosphere using a hydrogen balloon, then filtered through a Celite pad, and concentrated under reduced pressure to afford tert-butyl 4-[7-([8-fluoro-2-methylimidazo[1,2-a]pyridin-6-yl]carbamoyl)-2-methyl-1-benzofuran-4-yl]piperidine-1-carboxylate (120 mg) as a solid. LCMS (ES, m/z): 507 [M+H]$^+$.

Synthesis of Compound 145

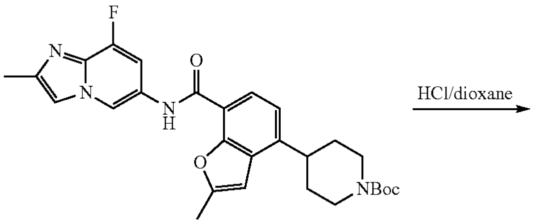

B253

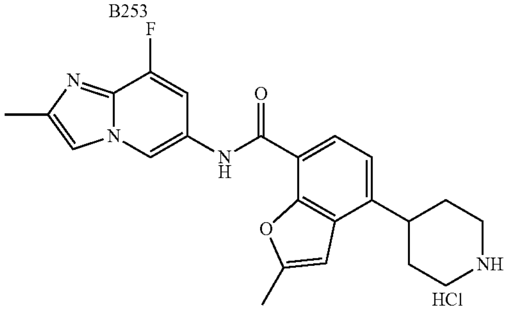

145

A mixture of tert-butyl 4-[7-([8-fluoro-2-methylimidazo[1,2-a]pyridine-6-yl]carbamoyl)-2-methyl-1-benzofuran-4-yl]piperidine-1-carboxylate (110.00 mg), HCl (gas) in 1,4-dioxane (2 mL), and methanol (2 mL) was stirred for 30 min at room temperature, then concentrated under reduced pressure to give a residue. The residue was purified by reverse flash chromatography (Column: silica gel; Mobile Phase: acetonitrile in water; Gradient: 10% to 50% in 10 min; detector, UV 254 nm), followed by prep-HPLC (Condition 1, Gradient 23) to afford N-[8-fluoro-2-methylimidazo[1,2-a]pyridin-6-yl]-2-methyl-4-(piperidin-4-yl)-1-benzofuran-7-carboxamide (90 mg) as a solid. LCMS (ES, m/z): 407 [M+H]$^+$.

Example 28: Synthesis of Compound 256

Synthesis of Compound 256

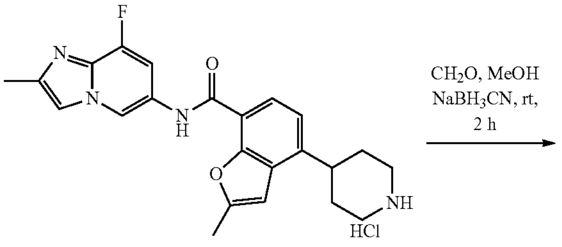

145

-continued

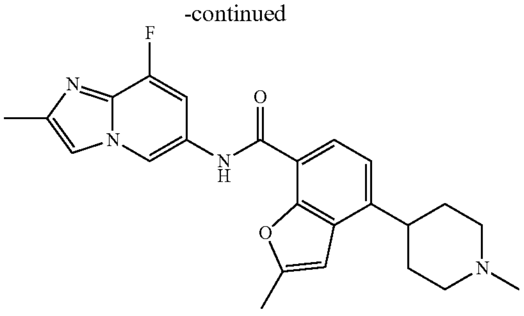

256

A mixture of N-[8-fluoro-2-methylimidazo[1,2-a]pyridin-6-yl]-2-methyl-4-(piperidin-4-yl)-1-benzofuran-7-carboxamide (45.00 mg, 0.111 mmol, 1.00 equiv), HCHO (2.00 mL, 54.619 mmol, 493.35 equiv), and methanol (4 mL) was stirred for 1 h at room temperature. To the reaction mixture was added NaBH$_3$CN (10.00 mg, 0.159 mmol, 1.44 equiv) dropwise at room temperature. The resulting mixture was stirred for an additional 30 min at room temperature, then concentrated in vacuo to give a residue. The residue was purified by reverse flash chromatography (Column: silica gel; Mobile Phase: acetonitrile in water; Gradient: 10% to 50% in 10 min; detector, UV 254 nm) followed by prep-HPLC (Condition 1, Gradient 23) to afford N-[8-fluoro-2-methylimidazo[1,2-a]pyridin-6-yl]-2-methyl-4-(1-methylpiperidin-4-yl)-1-benzofuran-7-carboxamide (17.1 mg, 36.73%) as a solid. LCMS (ES, m/z): 421 [M+H]$^+$. $^1$H NMR (400 MHz, DMSO-d$_6$) δ 10.28 (s, 1H), 9.17 (d, J=1.6 Hz, 1H), 7.93 (dd, J=3.2, 1.0 Hz, 1H), 7.58 (d, J=7.8 Hz, 1H), 7.28 (dd, J=12.6, 1.6 Hz, 1H), 7.21 (d, J=7.9 Hz, 1H), 6.85 (d, J=1.3 Hz, 1H), 2.92 (dd, J=8.9, 5.6 Hz, 2H), 2.84 (dq, J=10.6, 4.9 Hz, 1H), 2.5 (m, 3H), 2.35 (s, 3H), 2.24 (s, 3H), 2.06 (dt, J=11.0, 5.6 Hz, 2H), 1.81 (td, J=10.6, 9.8, 3.7 Hz, 4H).

Example 29: Synthesis of Compound 257

Synthesis of Compound 257

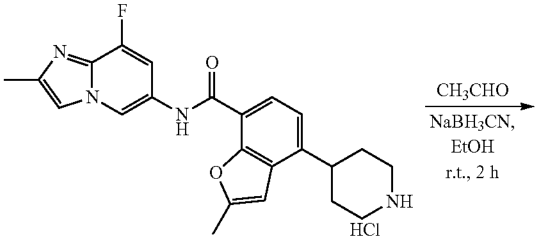

145

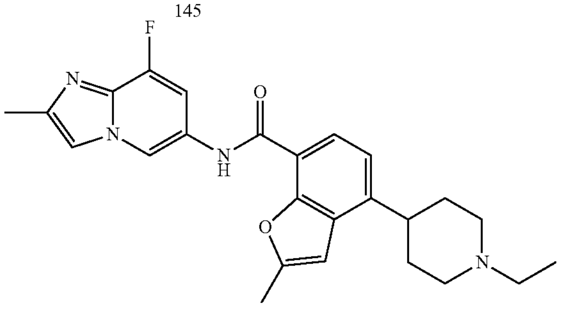

257

A mixture of N-[8-fluoro-2-methylimidazo[1,2-a]pyridin-6-yl]-2-methyl-4-(piperidin-4-yl)-1-benzofuran-7-carboxamide (45.00 mg), $CH_3CHO$ (2.00 mL), and ethanol (4 mL) was stirred for 1 h at room temperature. To the reaction mixture was added $NaBH_3CN$ (10.00 mg). The resulting mixture was stirred for an additional 1 h at room temperature, then concentrated under reduced pressure to give a residue. The residue was purified by reverse flash chromatography (Column: silica gel; Mobile Phase: acetonitrile in water; Gradient: 10% to 50% in 10 min; detector, UV 254 nm), followed by prep-HPLC (Condition 1, Gradient 23) to afford 4-(1-ethylpiperidin-4-yl)-N-[8-fluoro-2-methylimidazo[1,2-a]pyridin-6-yl]-2-methyl-1-benzofuran-7-carboxamide (16.7 mg) as a solid. LCMS (ES, m/z): 435 $[M+H]^+$. $^1H$ NMR (400 MHz, DMSO-$d_6$) δ 10.28 (s, 1H), 9.17 (d, J=1.6 Hz, 1H), 7.93 (d, J=3.1 Hz, 1H), 7.58 (d, J=7.8 Hz, 1H), 7.28 (dd, J=12.6, 1.7 Hz, 1H), 7.22 (d, J=7.8 Hz, 1H), 6.85 (s, 1H), 3.02 (dd, J=8.8, 5.4 Hz, 2H), 2.89 (q, J=7.7, 7.2 Hz, 1H), 2.51 (s, 3H), 2.44-2.33 (m, 5H), 2.11-1.98 (m, 2H), 1.80 (dt, J=9.2, 4.5 Hz, 4H), 1.05 (t, J=7.2 Hz, 3H).

Example 30: Synthesis of Compound 271

Synthesis of Intermediate B254

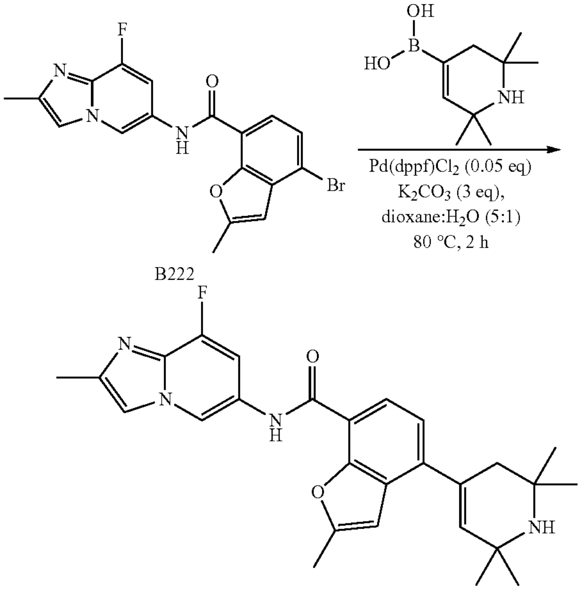

B222

B254

To a mixture of 4-bromo-N-[8-fluoro-2-methylimidazo[1,2-a]pyridin-6-yl]-2-methyl-1-benzofuran-7-carboxamide (100.00 mg, 0.249 mmol, 1.00 equiv) and 2,2,6,6-tetramethyl-1,3-dihydropyridin-4-ylboronic acid (45.51 mg, 0.249 mmol, 1 equiv) in 1,4-dioxane (20 mL) and water (4 ml) was added Pd(dppf)$Cl_2$ (20.25 mg, 0.025 mmol, 0.1 equiv) and $K_2CO_3$ (103.08 mg, 0.746 mmol, 3.00 equiv). The reaction mixture as stirred for 2 h at 80° C. under a nitrogen atmosphere, then concentrated under reduced pressure to give a residue. The residue was purified by Prep-TLC/silica gel column chromatography, eluted with $CH_2Cl_2$/methanol (10:1), to afford N-[8-fluoro-2-methylimidazo[1,2-a]pyridin-6-yl]-2-methyl-4-(2,2,6,6-tetramethyl-1,3-dihydropyridin-4-yl)-1-benzofuran-7-carboxamide (64 mg, 55.89%) as a solid. LCMS (ES, m/z): 461 $[M+H]^+$.

Synthesis of Compound 271

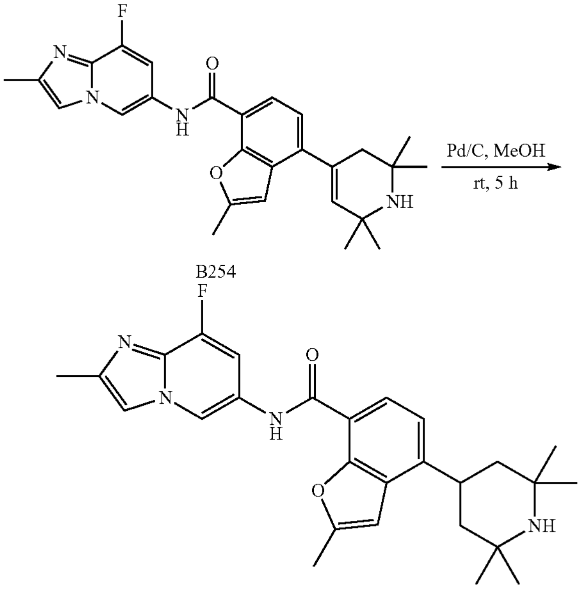

B254

271

A mixture of N-[8-fluoro-2-methylimidazo[1,2-a]pyridin-6-yl]-2-methyl-4-(2,2,6,6-tetramethyl-1,3-dihydropyridin-4-yl)-1-benzofuran-7-carboxamide (54 mg), Pd/C (1.00 mg), and methanol (1.00 mL) was stirred for 5 h at room temperature. The resulting mixture was filtered and the filter cake was washed with methanol (3×10 mL). The filtrate was concentrated under reduced pressure to give a residue. The residue was purified by reverse flash chromatography (Column: silica gel; Mobile Phase: acetonitrile in water; Gradient: 10% to 50% in 10 min; detector, UV 254 nm), followed by prep-HPLC (Condition 1, Gradient 23) to afford N-[8-fluoro-2-methylimidazo[1,2-a]pyridin-6-yl]-2-methyl-4-(2,2,6,6-tetramethylpiperidin-4-yl)-1-benzofuran-7-carboxamide (5 mg) as a solid. LCMS (ES, m/z): 463 $[M+H]^+$. $^1H$ NMR (400 MHz, DMSO-d6) δ 10.31 (s, 1H), 9.17 (d, J=1.6 Hz, 1H), 8.36 (s, 2H), 7.94 (d, J=3.1 Hz, 1H), 7.61 (d, J=7.9 Hz, 1H), 7.30 (dd, J=12.5, 1.7 Hz, 1H), 7.21 (d, J=7.9 Hz, 1H), 6.92 (d, J=1.3 Hz, 1H), 3.53-3.42 (m, 1H), 2.53 (d, J=1.1 Hz, 3H), 2.36 (s, 3H), 1.73-1.66 (s, 2H), 1.61-1.52 (m, 2H), 1.40 (s, 6H), 1.24 (s, 6H).

Example 31: Synthesis of Compound 277

Synthesis of Intermediate 255

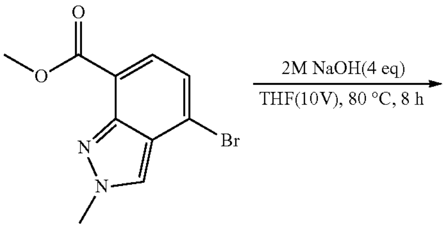

-continued

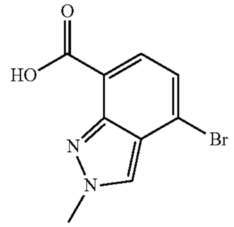

B255

A mixture of methyl 4-bromo-2-methylindazole-7-carboxylate (1.5 g, 5.57 mmol, 1.00 equiv) and NaOH (2 M) (10 mL, 4.00 equiv) in THF (10 mL) was stirred for 8 h at 80° C. The reaction mixture was acidified to pH 4 with HCl (aq.), then extracted with diethyl ether (3×20 mL). The combined organic layers were washed with saturated NaCl aq (1×20 mL), dried over anhydrous $MgSO_4$, and filtered. After filtration, the filtrate was concentrated under reduced pressure to afford 4-bromo-2-methylindazole-7-carboxylic acid (1.1 g, 77.3%) as a solid. LCMS (ES, m/z): 255 $[M+H]^+$.

Synthesis of Intermediate B256

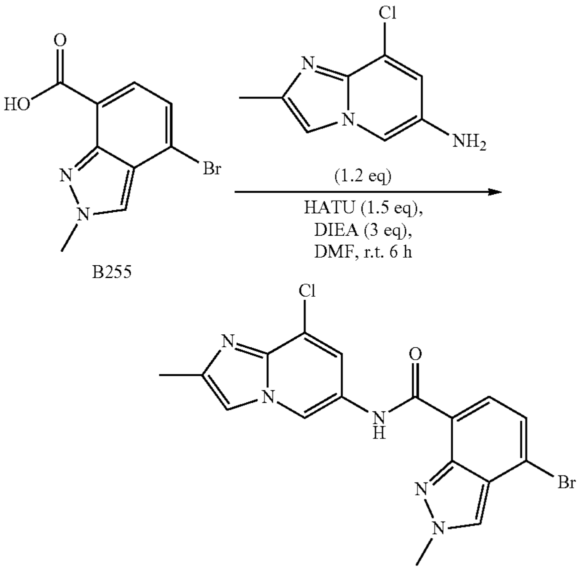

B255

B256

To a mixture of 4-bromo-2-methylindazole-7-carboxylic acid (1.1 g, 4.31 mmol, 1.00 equiv) and 8-chloro-2-methylimidazo[1,2-a]pyridin-6-amine (1.1 g, 6.47 mmol, 1.50 equiv) in DMF (30 ml) was added HATU (2.4 g, 6.47 mmol, 1.50 equiv) and DIEA (1.6 g, 12.94 mmol, 3.00 equiv) in portions. The reaction mixture was stirred for 6 h at room temperature, then extracted with diethyl ether (3×20 mL). The combined organic layers were washed with saturated NaCl (1×20 mL), dried over anhydrous $Na_2SO_4$, and filtered. After filtration, the filtrate was concentrated under reduced pressure to give a residue. The residue was purified by silica gel column chromatography, eluted with $CH_2Cl_2$/PE (5:01), to afford 4-bromo-N-{8-chloro-2-methylimidazo[1,2-a]-pyridin-6-yl}-2-methylindazole-7-carboxamide (1.20 g, 66.4%) as a solid. LCMS (ES, m/z): 418 $[M+H]^+$.

Synthesis of Intermediate B257

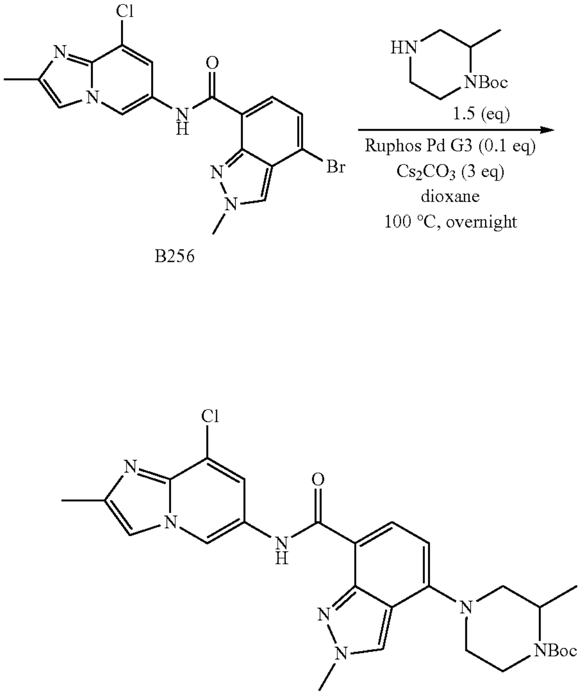

B256

B257

To a stirred mixture of 4-bromo-N-{8-chloro-2-methylimidazo[1,2-a]pyridin-6-yl}-2-methylindazole-7-carboxamide (100.0 mg, 0.24 mmol, 1.00 equiv) and tert-butyl 2-methylpiperazine-1-carboxylate (71.7 mg, 0.36 mmol, 1.50 equiv) in 1,4-dioxane (3 mL) was added $Cs_2CO_3$ (233.4 mg, 0.72 mmol, 3.00 equiv) and RuPhos Palladacycle Gen.3 (19.98 mg, 0.02 mmol, 0.10 equiv) in portions. The reaction mixture was stirred for 10 h at 100° C. under nitrogen atmosphere, then extracted with diethyl ether (3×10 mL). The combined organic layers were washed with saturated NaCl (1×10 mL), dried over anhydrous $Na_2SO_4$, and filtered. After filtration, the filtrate was concentrated under reduced pressure to give a residue. The residue was purified by silica gel column chromatography, eluted with PE/EA (1:4), to afford tert-butyl 4-[7-({8-chloro-2-methy-limidazo[1,2-a]pyridin-6-yl}carbamoyl)-2-methylindazol-4-yl]-2-methylpiperazine-1-carboxylate as a solid. LCMS (ES, m/z): 538 $[M+H]^+$.

Synthesis of Compound 277

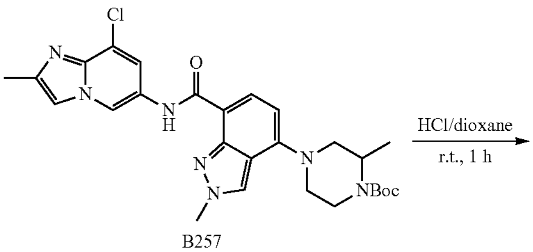

B257

-continued

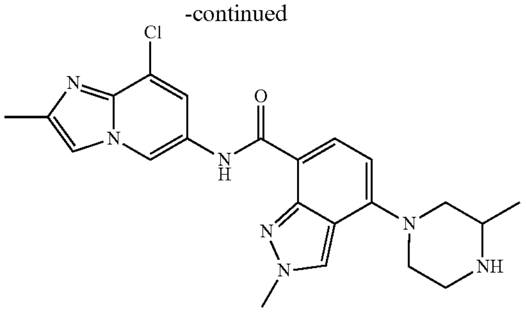

277

A solution of tert-butyl 4-[7-({8-chloro-2-methylimidazo[1,2-a]pyridin-6-yl}carbamoyl)-2-methylinda-zol-4-yl]-2-methylpiperazine-1-carboxylate (70.0 mg, 0.13 mmol, 1.00 equiv) in HCl/dioxane (4 mol/L, 10 mL) was stirred for 1 h at room temperature. The resulting mixture was concentrated under reduced pressure to give a residue. The residue was purified by reverse flash chromatography (Condition 1, Gradient 24) to afford N-{8-chloro-2-methylimidazo[1,2-a]pyridine-6-yl}-2-methyl-4-(3-methylpiperazin-1-yl)indazole-7-carboxamide as a solid (11.8 mg). LCMS (ES, m/z): 438 $[M+H]^+$. $^1H$ NMR (400 MHz, DMSO-$d_6$) δ 11.06 (s, 1H), 9.33 (d, J=1.7 Hz, 1H), 8.80 (s, 1H), 7.97 (d, J=8.1 Hz, 1H), 7.90 (s, 1H), 7.58 (d, J=1.8 Hz, 1H), 6.49 (d, J=8.2 Hz, 1H), 4.30 (s, 3H), 3.81-3.73 (m, 2H), 3.04-2.94 (m, 1H), 2.90 (t, J=9.7 Hz, 3H), 2.58-2.51 (m, 1H), 2.36 (s, 4H), 1.07 (d, J=6.3 Hz, 3H).

Example 32: Synthesis of Compound 278

Synthesis of Compound 278

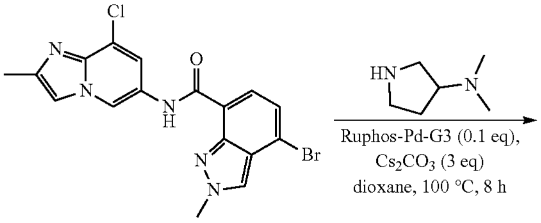

B256

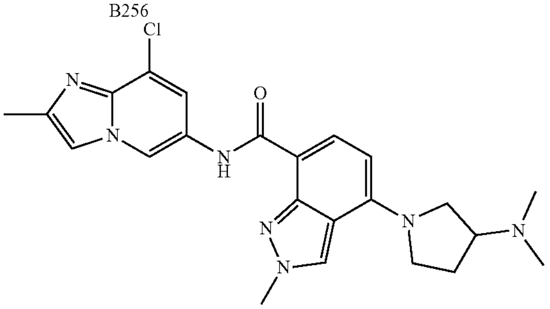

278

To a stirred mixture of 4-bromo-N-{8-chloro-2-methylimidazo[1,2-a]pyridin-6-yl}-2-methylindazole-7-carboxamide (200.00 mg, 0.49 mmol, 1.00 equiv) and N,N-dimethylpyrrolidin-3-amine (81.82 mg, 0.72 mmol, 1.50 equiv) in 1,4-dioxane was added RuPhos Palladacycle Gen.3 (39.95 mg, 0.05 mmol, 0.10 equiv) and $Cs_2CO_3$ (466.92 mg, 1.43 mmol, 3.00 equiv). The resulting mixture was stirred for 8 h at 100° C. under nitrogen atmosphere. The aqueous layer was extracted with diethyl ether (3×10 mL). The combined organic layers were washed with saturated NaCl (1×10 mL), dried over anhydrous $Na_2SO_4$, and filtered. After filtration, the filtrate was concentrated under reduced pressure to give a residue. The residue was purified by silica gel column chromatography, eluted with $CH_2Cl_2$/MeOH (1:4), followed by prep-HPLC (Condition 9, Gradient 6) to afford N-{8-chloro-2-methylimidazo[1,2-a]pyridin-6-yl}-4-[3-(dimethylamino)pyrrolidin-1-yl]-2-methylindazole-7-carboxamide (31.90 mg) as a solid. LCMS (ES, m/z): 452 $[M+H]^+$. $^1H$ NMR (400 MHz, DMSO-$d_6$) δ 10.99 (s, 1H), 9.30 (d, J=1.7 Hz, 1H), 8.85 (s, 1H), 7.93 (d, J=8.2 Hz, 1H), 7.88 (s, 1H), 7.52 (d, J=1.7 Hz, 1H), 6.04 (d, J=8.4 Hz, 1H), 4.28 (s, 3H), 3.83 (t, J=8.4 Hz, 1H), 3.76 (t, J=9.4 Hz, 1H), 3.68-3.57 (m, 1H), 3.45 (t, J=9.1 Hz, 1H), 2.91 (d, J=8.1 Hz, 1H), 2.35 (s, 3H), 2.29 (s, 6H), 2.27-2.20 (m, 1H), 1.92 (q, J=10.3 Hz, 1H).

Example 33: Synthesis of Compound 285

Synthesis of Intermediate B258

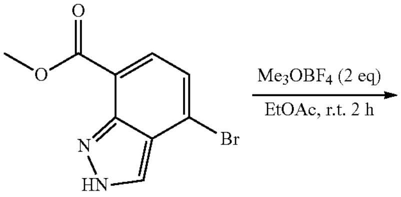

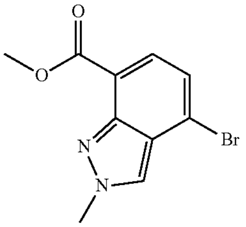

B258

A mixture of methyl 4-bromo-2H-indazole-7-carboxylate (500.0 mg, 1.96 mmol, 1.00 equiv) and tetrafluoroboranuide; trimethyloxidanium (579.8 mg, 3.92 mmol, 2.00 equiv) in ethyl acetate (10.00 mL, 102.14 mmol, 52.11 equiv) was stirred for 16 h at room temperature. The resulting mixture was partitioned between water and ethyl acetate, and extracted with ethyl acetate (3×10 mL). The combined organic layers were washed with saturated NaCl (1×10 mL), dried over anhydrous $Na_2SO_4$, and filtered. After filtration, the filtrate was concentrated under reduced pressure to afford methyl 4-bromo-2-methylindazole-7-carboxylate (500.0 mg, 94.7%) as a solid. LCMS (ES, m/z): 269 $[M+H]^+$.

Synthesis of Intermediate B259

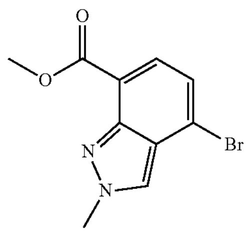

B258

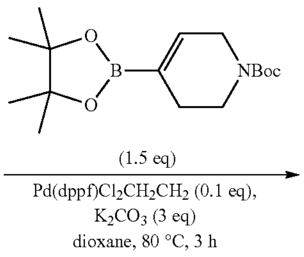

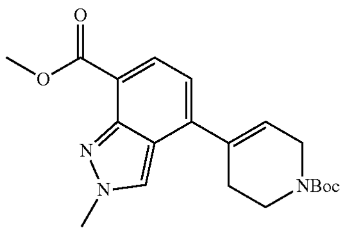

B259

To a stirred mixture of methyl 4-bromo-2-methylindazole-7-carboxylate (170.0 mg, 0.63 mmol, 1.00 equiv) and tert-butyl 4-(4,4,5,5-tetramethyl-1,3,2-dioxaborolan-2-yl)-3,6-dihydro-2H-pyridine-1-carboxylate (293.0 mg, 0.95 mmol, 1.50 equiv) in 1,4-dioxane (5 mL) was added Pd(dppf)$Cl_2CH_2Cl_2$ (51.4 mg, 0.06 mmol, 0.10 equiv) and $K_2CO_3$ (261.9 mg, 1.90 mmol, 3.00 equiv). The reaction mixture was stirred for 3 h at 80° C. under nitrogen atmosphere, then extracted with ethyl acetate (3×10 mL). The combined organic layers were washed with saturated NaCl (1×10 mL), dried over anhydrous $Na_2SO_4$, and filtered. After filtration, the filtrate was concentrated under reduced pressure to give a residue. The residue was purified by silica gel column chromatography, eluted with $CH_2Cl_2$/PE (5:01), to afford methyl 4-[1-(tert-butoxycarbonyl)-3,6-dihydro-2H-pyridin-4-yl]-2-methylindazole-7-carboxylate (180.0 mg, 76.7%) as a solid. LCMS (ES, m/z): 371 $[M+H]^+$.

Synthesis of Intermediate B260

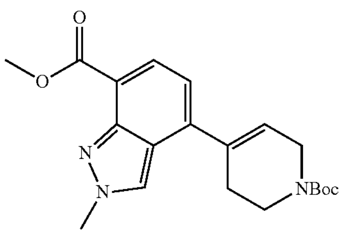

B259

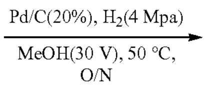

-continued

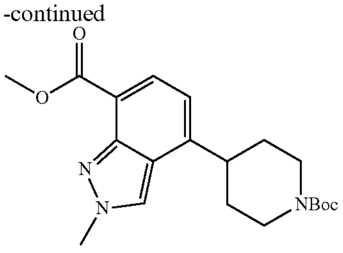

B260

To a stirred mixture of methyl 4-[1-(tert-butoxycarbonyl)-3,6-dihydro-2H-pyridin-4-yl]-2-methy lindazole-7-carboxylate (180.0 mg, 0.49 mmol, 1.00 equiv) and Pd/C (36.00 mg) in MeOH was added $H_2$ (4 MPa). The reaction mixture was stirred for 2 days at 50° C. The resulting mixture was filtered, and the filter cake washed with MeOH (3×5 mL). The filtrate was concentrated under reduced pressure to afford methyl 4-[1-(tert-butoxycarbonyl)-piperidin-4-yl]-2-methylindazole-7-carboxylate (180.0 mg, 99.4%) as an oil. LCMS (ES, m/z): 374 $[M+H]^+$.

Synthesis of Intermediate B261

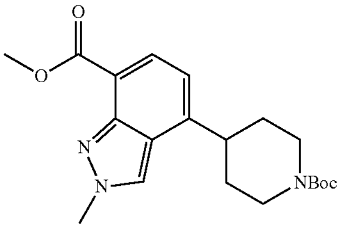

B260

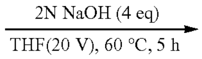

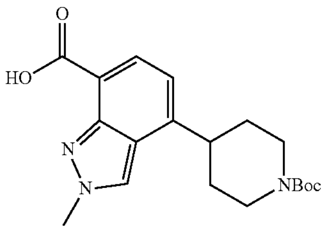

B261

A mixture of methyl 4-[1-(tert-butoxycarbonyl)piperidin-4-yl]-2-methylindazole-7-carboxylate (180.0 mg, 0.48 mmol, 1.00 equiv) and NaOH (2M) (9.6 mL, 4.00 equiv) in THF (10 mL) was stirred for 5 h at 50° C. The reaction mixture was acidified to pH 4 with HCl (aq.). The resulting mixture was extracted with ethyl acetate (3×10 mL). The combined organic layers were washed with saturated NaCl (1×10 mL), dried over anhydrous $Na_2SO_4$, and filtered. After filtration, the filtrate was concentrated under reduced pressure to afford 4-[1-(tert-butoxycarbonyl)-piperidin-4-yl]-2-methylindazole-7-carboxylic acid (160.0 mg, 92.3%) as a solid. LCMS (ES, m/z): 360 $[M+H]^+$.

Synthesis of Intermediate B262

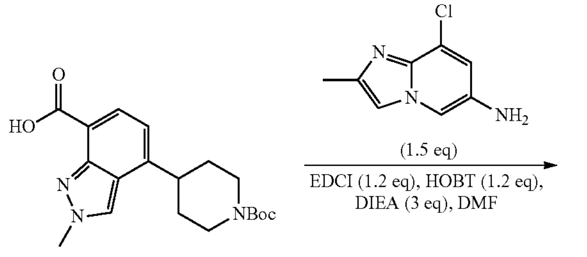

B261

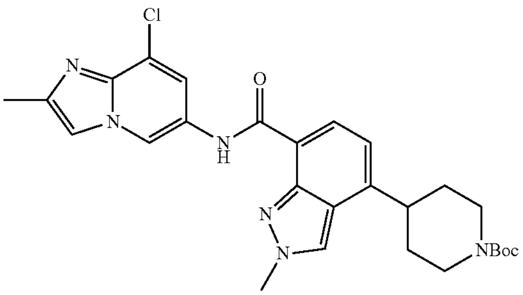

B262

To a stirred mixture of 4-[1-(tert-butoxycarbonyl)piperidin-4-yl]-2-methylindazole-7-carboxylic acid (80.00 mg, 0.22 mmol, 1.00 equiv) and 8-chloro-2-methylimidazo[1,2-a]pyridin-6-amine (48.51 mg, 0.27 mmol, 1.20 equiv) in DMF (5 ml) was added HOBT (36.09 mg, 0.27 mmol, 1.20 equiv), DIEA (86.30 mg, 0.67 mmol, 3.00 equiv) and EDCI (51.20 mg, 0.27 mmol, 1.20 equiv). The reaction mixture was stirred for 6 h at 40° C. The resulting mixture was extracted with ethyl acetate (3x10 mL). The combined organic layers were washed with saturated NaCl (1x10 mL), dried over anhydrous $Na_2SO_4$, and filtered. After filtration, the filtrate was concentrated under reduced pressure to afford tert-butyl 4-[7-({8-chloro-2-methylimidazo[1,2-a]pyridin-6-yl}carbamoyl)-2-methylindazol-4-yl]piperidine-1-carboxylate (100.00 mg, 85.90%) as a solid. LCMS (ES, m/z): 523 [M+H]+.

Synthesis of Compound 285

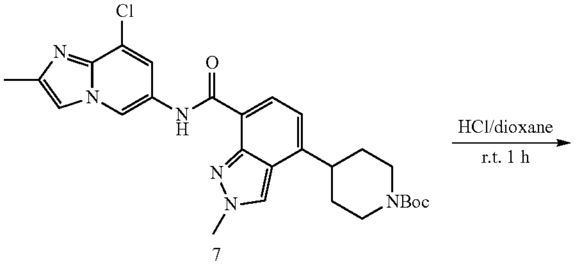

7
B262

-continued

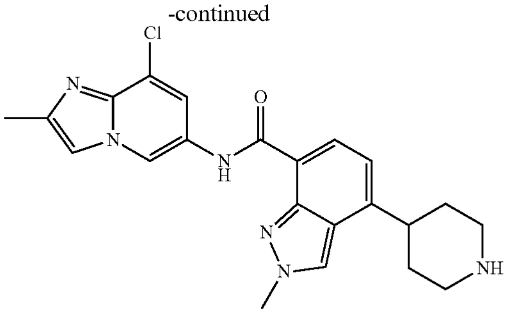

285

A solution of tert-butyl 4-[7-({8-chloro-2-methylimidazo[1,2-a]pyridin-6-yl}carbamoyl)-2-methy-lindazol-4-yl]piperidine-1-carboxylate (100.00 mg, 0.19 mmol, 1.00 equiv) in HCl/dioxane (5 mL) was stirred for 1 h at room temperature. The resulting mixture was concentrated under reduced pressure to give a residue. The residue was purified by prep-HPLC (Condition 9, Gradient 7) to afford N-{8-chloro-2-methylimidazo[1,2-a]pyridin-6-yl}-2-methyl-4-(piperidin-4-yl) indazole-7-carboxamide (24.3 mg, 30.05%) as a solid. LCMS (ES, m/z): 423 [M+H]+. $^1$H NMR (400 MHz, DMSO-$d_6$) δ 11.12 (s, 1H), 9.36 (d, J=1.8 Hz, 1H), 8.88 (s, 1H), 8.04 (d, J=7.3 Hz, 1H), 7.92 (s, 1H), 7.60 (d, J=1.7 Hz, 1H), 7.10 (d, J=7.4 Hz, 1H), 4.35 (s, 3H), 3.08 (t, J=11.3 Hz, 3H), 2.71 (d, J=11.2 Hz, 2H), 2.36 (s, 3H), 1.82 (d, J=12.3 Hz, 2H), 1.74 (dd, J=11.6, 3.6 Hz, 2H).

Example 34: Synthesis of Compound 286

Synthesis of Intermediate B263

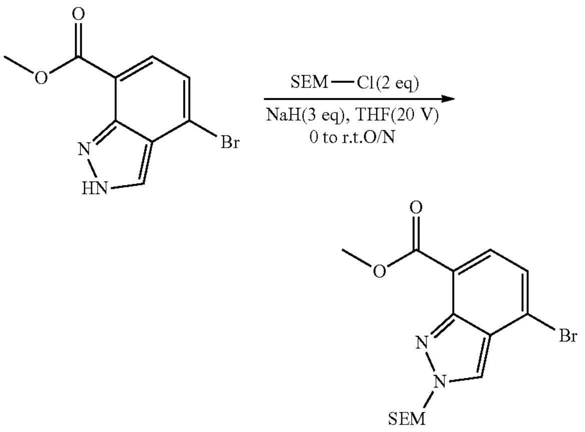

B263

To a stirred mixture of methyl 4-bromo-2H-indazole-7-carboxylate (2.0 g, 7.84 mmol, 1.00 equiv) and NaH (0.56 g, 23.52 mmol, 3.00 equiv) in THF (40 mL) was added SEM-Cl (2.61 g, 15.68 mmol, 2.00 equiv). The reaction mixture was stirred for 4 h at 0° C., then partitioned between water and ethyl acetate and extracted with ethyl acetate (3x20 mL). The combined organic layers were washed with saturated NaCl (1x40 mL), dried over anhydrous $Na_2SO_4$, and filtered. After filtration, the filtrate was concentrated under reduced pressure to afford methyl 4-bromo-2-{[2-(trimethylsilyl)ethoxy]methyl}indazole-7-carboxylate (1.50 g, 49.65%) as a solid. LCMS (ES, m/z): 385 [M+H]+.

Synthesis of Intermediate B264

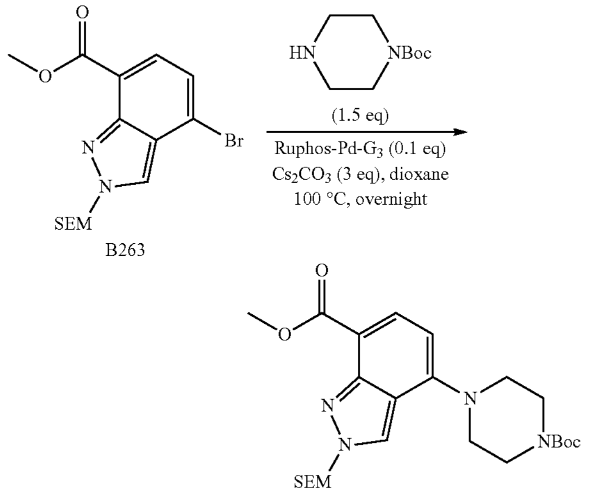

B263

B264

To a stirred mixture of methyl 4-bromo-2-{[2-(trimethylsilyl)ethoxy]methyl}indazole-7-carboxylate (1.50 g, 3.89 mmol, 1.00 equiv) and tert-butyl piperazine-1-carboxylate (1.09 g, 5.84 mmol, 1.50 equiv) in 1,4-dioxane (100 mL) was added RuPhos Palladacycle Gen.3 (0.33 g, 0.39 mmol, 0.10 equiv) and $Cs_2CO_3$ (3.80 g, 11.68 mmol, 3.00 equiv). The reaction mixture was stirred for 8 h at 100° C. under nitrogen atmosphere. The resulting mixture was extracted with ethyl acetate (3×50 mL). The combined organic layers were washed with saturated NaCl (lx 50 mL), dried over anhydrous $Na_2SO_4$, and filtered. After filtration, the filtrate was concentrated under reduced pressure. The residue was purified by silica gel column chromatography, eluted with $CH_2Cl_2$/MeOH (10:01), to afford methyl 4-[4-(tert-butoxycarbonyl)piperazin-1-yl]-2-{[2-(trimethylsilyl)-ethoxy]methyl}indazole-7-carboxylate (0.95 g, 49.74%) as a solid. LCMS (ES, m/z): 491 $[M+H]^+$.

Synthesis of Intermediate B265

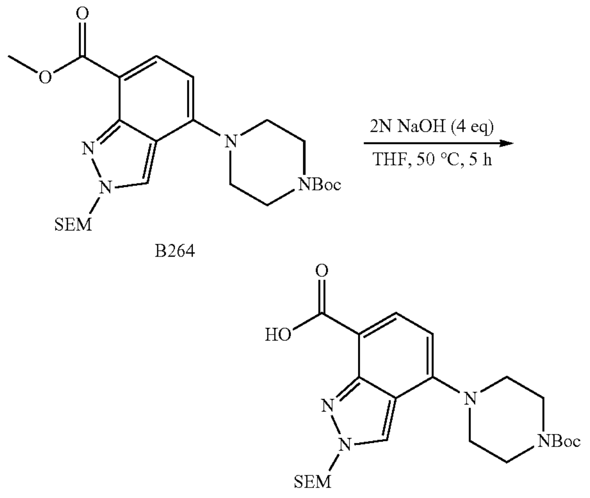

B264

B265

A mixture of methyl 4-[4-(tert-butoxycarbonyl)piperazin-1-yl]-2-{[2-(trimethylsilyl) ethoxy]methyl}indazole-7-carboxylate (500.00 mg, 1.02 mmol, 1.00 equiv) and NaOH (2M) (20 mL, 4.00 equiv) in THF (20 mL) was stirred for 5 h at 50° C. The reaction mixture was acidified to pH 4 with HCl (aq.). The resulting mixture was extracted with ethyl acetate (3×20 mL). The combined organic layers were washed with saturated NaCl (1×20 mL), dried over anhydrous $Na_2SO_4$, and filtered. After filtration, the filtrate was concentrated under reduced pressure to afford 4-[4-(tert-butoxycarbonyl)piperazin-1-yl]-2-{[2-(trimethylsilyl) ethoxy]methyl}indazole-7-carboxylic acid (450 mg, 92.65%) as a solid. LCMS (ES, m/z): 477 $[M+H]^+$.

Synthesis of Intermediate B266

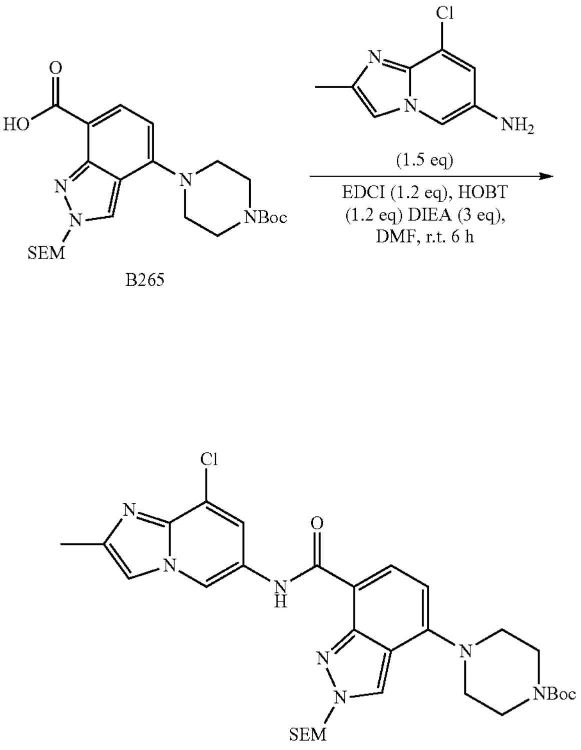

B265

B266

To a stirred mixture of 4-[4-(tert-butoxycarbonyl)piperazin-1-yl]-2-{[2-(trimethylsilyl)ethoxy]methyl}indazole-7-carboxylic acid (450.0 mg, 0.94 mmol, 1.00 equiv) and 8-chloro-2-methylimidazo [1,2-a]pyridin-6-amine (257.2 mg, 1.42 mmol, 1.50 equiv) in DMF (10 mL) was added HOBT (153.0 mg, 1.13 mmol, 1.20 equiv), DIEA (146.4 mg, 1.13 mmol, 1.20 equiv), and EDCI (542.9 mg, 2.83 mmol, 3.00 equiv). The reaction mixture was stirred for 8 h at 40° C., then extracted with ethyl acetate (3×10 mL). The combined organic layers were washed with saturated NaCl (1×10 mL), dried over anhydrous $Na_2SO_4$, and filtered. After filtration, the filtrate was concentrated under reduced pressure to afford tert-butyl 4-[7-({8-chloro-2-methylimidazo[1,2-a]pyridine-6-yl}carbamoyl)-2-{[2-(trimethyl silyl) ethoxy]methyl}-indazol-4-yl]piperazine-1-carboxylate (560.0 mg, 92.6%) as a solid. LCMS (ES, m/z): 640 $[M+H]^+$.

Synthesis of Compound 286

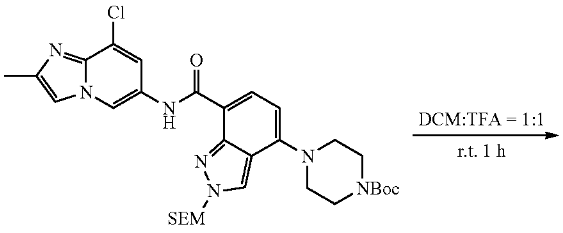

B266

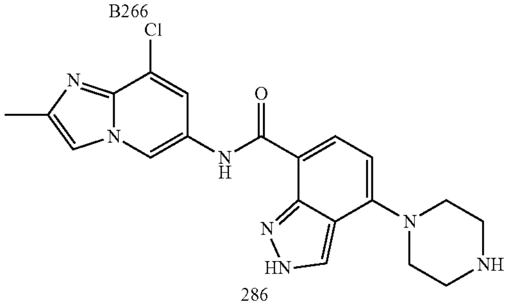

286

A solution of tert-butyl 4-[7-({8-chloro-2-methylimidazo [1,2-a]pyridine-6-yl}carbamoyl)-2-{[2-(tri methylsilyl) ethoxy]methyl}indazol-4-yl]piperazine-1-carboxylate (100.00 mg, 0.16 mmol, 1.00 equiv) in TFA/DCM (1:1) (5 mL) was stirred for 2 h at room temperature. The resulting mixture was concentrated under reduced pressure to give a residue. The residue was purified by prep-HPLC (Condition 1, Gradient 19) to afford N-{8-chloro-2-methylimidazo[1,2-a]pyridin-6-yl}-4-(piperazin-1-yl)-2H-indazole-7-carboxamide (25.5 mg, 36.55%) as a solid. LCMS (ES, m/z): 410 $[M+H]^+$. $^1$H-NMR (400 MHz, DMSO-$d_6$) δ 13.01 (s, 1H), 10.21 (s, 1H), 9.15 (d, J=1.7 Hz, 1H), 8.24 (s, 1H), 7.99 (d, J=8.2 Hz, 1H), 7.91 (s, 1H), 7.68 (d, J=1.7 Hz, 1H), 6.55 (d, J=8.3 Hz, 1H), 3.40 (dd, J=6.3, 3.6 Hz, 4H), 2.96-2.89 (m, 4H), 2.36 (s, 3H).

Example 35: Synthesis of Compound 284

Synthesis of Intermediate B267

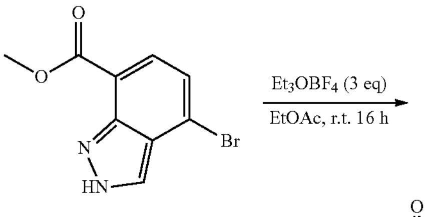

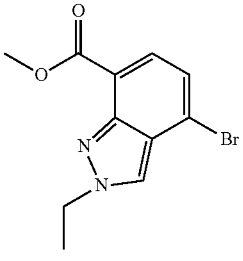

B267

A mixture of methyl 4-bromo-2H-indazole-7-carboxylate (500.00 mg, 1.96 mmol, 1.00 equiv) and tetrafluoroboranuide; triethyloxidanium (1117.26 mg, 5.88 mmol, 3.00 equiv) in AcOH (5 ml) was stirred for 20 h at room temperature. The resulting mixture was extracted with ethyl acetate (3×10 mL). The combined organic layers were washed with saturated NaCl (1×10 mL), dried over anhydrous $Na_2SO_4$, and filtered. After filtration, the filtrate was concentrated under reduced pressure to afford methyl 4-bromo-2-ethylindazole-7-carboxylate (480.0 mg, 86.4%) as a solid. LCMS (ES, m/z): 283 $[M+H]^+$.

Synthesis of Intermediate B268

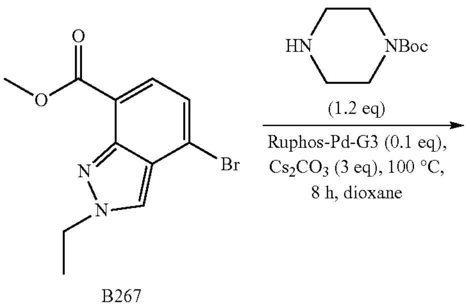

B267

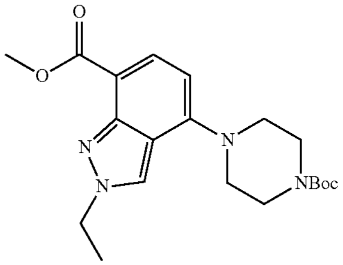

B268

To a stirred mixture of methyl 4-bromo-2-ethylindazole-7-carboxylate (480.00 mg, 1.70 mmol, 1.00 equiv) and tert-butyl piperazine-1-carboxylate (378.92 mg, 2.03 mmol, 1.20 equiv) in 1,4-dioxane (10 ml) was added RuPhos Palladacycle Gen.3 (141.80 mg, 0.17 mmol, 0.10 equiv), and $Cs_2CO_3$ (1657.15 mg, 5.09 mmol, 3.00 equiv) at 100° C. under nitrogen atmosphere. The resulting mixture was extracted with ethyl acetate (3×20 mL). The combined organic layers were washed with saturated NaCl (1×10 mL), dried over anhydrous $Na_2SO_4$, and filtered. After filtration, the filtrate was concentrated under reduced pressure to give a residue. The residue was purified by silica gel column chromatography, eluted with $CH_2Cl_2$/MeOH (10:01) to afford methyl 4-[4-(tert-butoxycarbonyl)piperazin-1-yl]-2-ethylindazole-7-carboxylate (390.00 mg, 59.22%) as a solid. LCMS (ES, m/z): 389 $[M+H]^+$ Synthesis of Intermediate B269

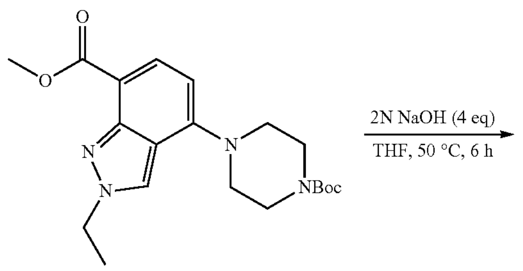

B268

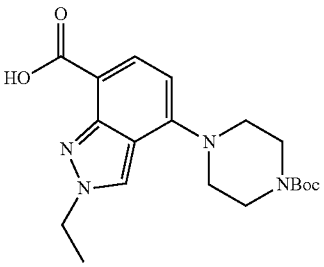

B269

A mixture of methyl 4-[4-(tert-butoxycarbonyl)piperazin-1-yl]-2-ethylindazole-7-carboxylate (390.00 mg, 1.00 mmol, 1.00 equiv) and NaOH (2M) (2 mL, 4.00 equiv) in THF (5 ml) was stirred for 5 h at 50° C. The reaction mixture was acidified to pH 4 with HCl (aq.). The resulting mixture was extracted with ethyl acetate (3×10 mL). The combined organic layers were washed with saturated NaCl (1×10 mL), dried over anhydrous $Na_2SO_4$, and filtered. After filtration, the filtrate was concentrated under reduced pressure to afford 4-[4-(tert-butoxycarbonyl)piperazin-1-yl]-2-ethylindazole-7-carboxylic acid (340.0 mg, 90.4%) as a solid. LCMS (ES, m/z): 375 $[M+H]^+$ Synthesis of Intermediate B270

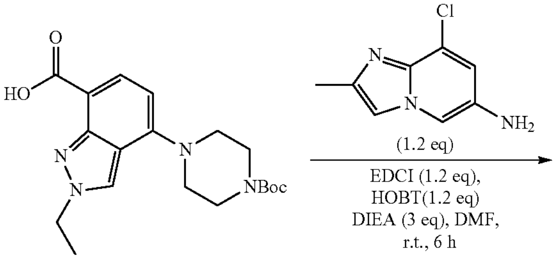

B269

-continued

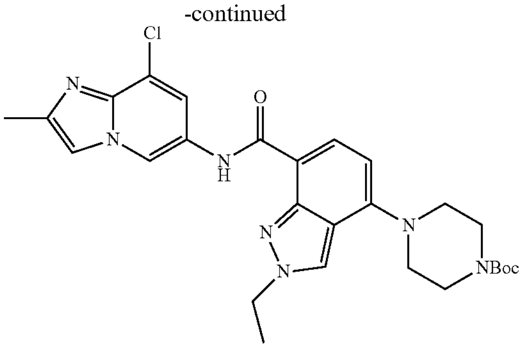

B270

To a stirred mixture of 4-[4-(tert-butoxycarbonyl)piperazin-1-yl]-2-ethylindazole-7-carboxylic acid (340.00 mg, 0.91 mmol, 1.00 equiv) and 8-chloro-2-methylimidazo[1,2-a]pyridin-6-amine (197.90 mg, 1.09 mmol, 1.20 equiv) in DMF (10 ml) was added HOBT (147.23 mg, 1.09 mmol, 1.20 equiv), DIEA (352.07 mg, 2.72 mmol, 3.00 equiv), and EDCI (208.88 mg, 1.09 mmol, 1.20 equiv). The reaction mixture was stirred for 6 h at 40° C., then extracted with ethyl acetate (3×10 mL). The combined organic layers were washed with saturated NaCl (1×10 mL), dried over anhydrous $Na_2SO_4$, and filtered. After filtration, the filtrate was concentrated under reduced pressure to afford tert-butyl 4-[7-({8-chloro-2-methylimidazo[1,2-a]pyridin-6-yl}carbamoyl)-2-ethylindazol-4-yl]piperazine-1-carboxylate (380.0 mg, 77.7%) as a solid. LCMS (ES, m/z): 538 $[M+H]^+$ Synthesis of Compound 284

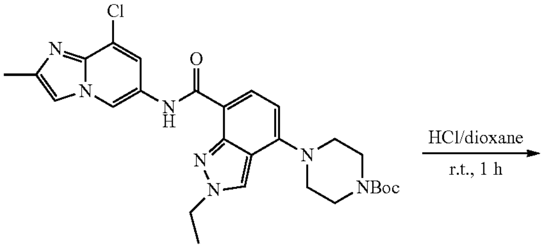

B270

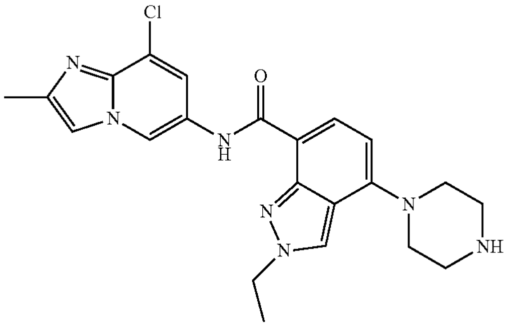

284

A solution of tert-butyl 4-[7-({8-chloro-2-methylimidazo[1,2-a]pyridin-6-yl}carbamoyl)-2-ethylinda-zol-4-yl]piperazine-1-carboxylate (100.00 mg, 0.19 mmol, 1.00 equiv) in HCl/dioxane (5 mL) was stirred for 1 h at room temperature. The resulting mixture was concentrated under reduced pressure to give a residue. The residue was purified by prep-HPLC (Condition 9, Gradient 8) to afford N-{8-chloro-2-methylimidazo[1,2-a]pyridin-6-yl}-2-ethyl-4-(piperazin-1-yl)indazole-7-carboxamide (26.1 mg, 32.0%) as a solid. LCMS (ES, m/z): 438 [M+H]$^+$. $^1$H-NMR (400 MHz, DMSO-$d_6$) δ 9.18 (d, J=1.7 Hz, 1H), 8.73 (s, 1H), 7.97 (d, J=8.0 Hz, 1H), 7.82 (s, 1H), 7.53 (d, J=1.7 Hz, 1H), 6.50 (d, J=8.1 Hz, 1H), 4.55 (q, J=7.3 Hz, 2H), 3.40 (dd, J=6.5, 3.6 Hz, 4H), 3.02-2.95 (m, 4H), 2.33 (s, 3H), 1.58 (t, J=7.3 Hz, 3H).

Example 36: Synthesis of Compound 283

Synthesis of Intermediate B271

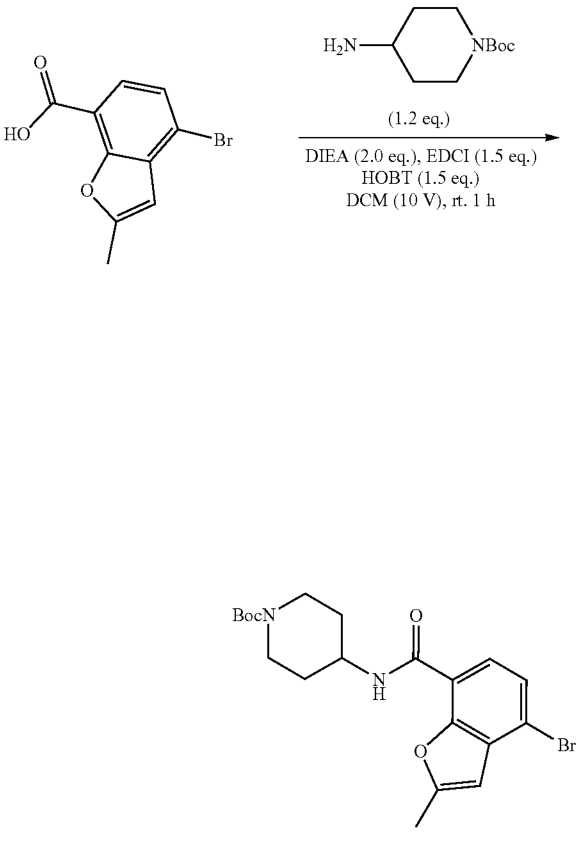

B271

4-bromo-2-methyl-1-benzofuran-7-carboxylic acid (300.00 mg, 1.10 mmol, 1.00 equiv), tert-butyl 4-aminopiperidine-1-carboxylate (282.0 mg, 1.40 mmol, 1.20 equiv), DIEA (304.0 mg, 2.30 mmol, 2.00 equiv), EDCI (338.0 mg, 1.70 mmol, 1.50 equiv), and HOBT (238.0 mg, 1.70 mmol, 1.50 equiv) were combined in DCM (3.0 mL) at room temperature. The reaction mixture was stirred for 1 h at room temperature, then concentrated under reduced pressure to a residue. The residue was purified by silica gel column chromatography, eluted with PE/EA (3:1), to afford tert-butyl 4-(4-bromo-2-methyl-1-benzofuran-7-amido) piperidine-1-carboxylate (300.0 mg, 58.3%) as a solid. LCMS (ES, m/z): 437 [M+H]$^+$.

Synthesis of Intermediate B272

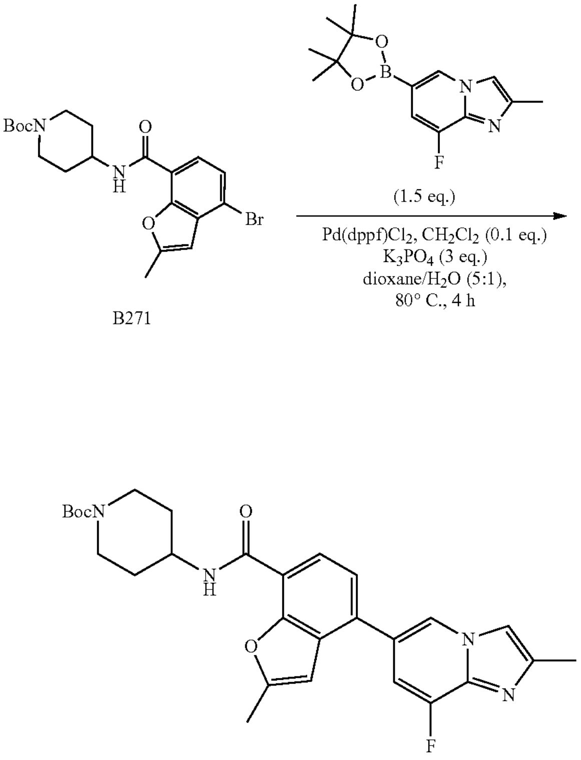

B271

B272

To a solution of tert-butyl 4-(4-bromo-2-methyl-1-benzofuran-7-amido) piperidine-1-carboxylate (100.0 mg, 0.20 mmol, 1.00 equiv) and 8-fluoro-2-methyl-6-(4,4,5,5-tetramethyl-1,3,2-dioxaborolan-2-yl) imidazo-[1,2-a]pyridine (75.0 mg, 0.20 mmol, 1.20 equiv) in a mixture of dioxane (5.0 mL) and water (1.0 mL) was added $K_3PO_4$ (145.0 mg, 0.60 mmol, 3.00 equiv) and Pd(dppf)$C_{12}$·$CH_2Cl_2$ (18.0 mg, 0.02 mmol, 0.10 equiv). After stirring for 3 h at 80° C. under a nitrogen atmosphere, the resulting mixture was concentrated under reduced pressure to give a residue. The residue was purified by Prep-TLC/silica gel column chromatography, eluted with PE/EA (1:1), to afford tert-butyl 4-(4-{8-fluoro-2-methylimidazo[1,2-a]pyridin-6-yl}-2-methyl-1-benzofuran-7-amido) piperidine-1-carboxylate (100.0 mg, 86.3%) as an oil. LCMS (ES, m/z): 507 [M+H]$^+$.

Synthesis of Compound 283

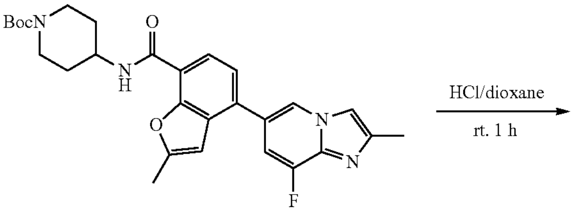

B272

-continued

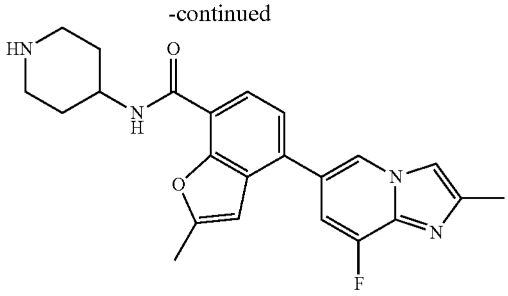

283

A mixture of tert-butyl 4-(4-{8-fluoro-2-methylimidazo[1,2-a]pyridin-6-yl}-2-methyl-1-benzofuran-7-amido) piperidine-1-carboxylate (50.0 mg, 0.10 mmol, 1.00 equiv) and HCl (gas) in 1,4-dioxane (1 mL) was stirred for 1 h at room temperature, then concentrated under reduced pressure to give a residue. The residue was purified by prep-HPLC (Condition 1, Gradient 18) to afford 4-{8-fluoro-2-methylimidazo[1,2-a]pyridin-6-yl}-2-methyl-N-(piperidin-4-yl)-1-benzofuran-7-carboxamide (14.9 mg, 37.2%) as a white solid. LCMS (ES, m/z): 407 $[M+H]^+$. $^1$H-NMR (400 MHz, DMSO-$d_6$) δ 8.71 (d, J=1.4 Hz, 1H), 8.08 (d, J=7.8 Hz, 1H), 7.91 (dd, J=3.1, 1.0 Hz, 1H), 7.66 (d, J=7.9 Hz, 1H), 7.47 (d, J=7.9 Hz, 1H), 7.40 (dd, J=12.1, 1.5 Hz, 1H), 6.96 (t, J=1.1 Hz, 1H), 3.98-3.86 (m, 1H), 3.02-2.92 (m, 2H), 2.58 (dd, J=12.0, 2.5 Hz, 2H), 2.54 (d, J=1.1 Hz, 3H), 2.40 (d, J=0.9 Hz, 3H), 1.84 (dd, J=11.7, 4.0 Hz, 2H), 1.55-1.40 (m, 2H).

Example 37: Synthesis of Compound 282

Synthesis of Intermediate B273

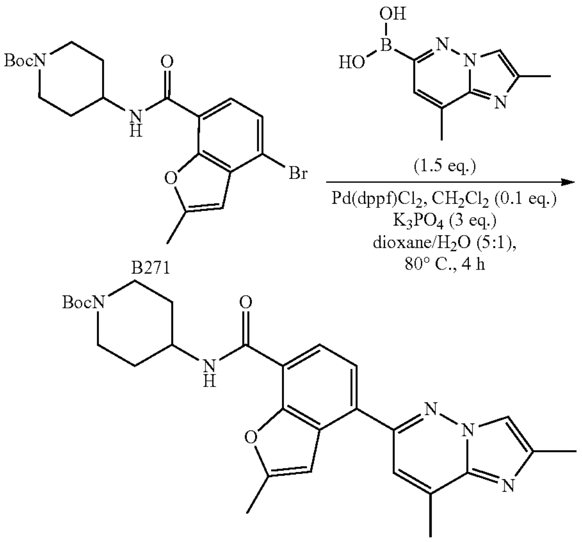

B271

B273

To a mixture of tert-butyl 4-(4-bromo-2-methyl-1-benzofuran-7-amido) piperidine-1-carboxylate (100.0 mg, 0.20 mmol, 1.00 equiv) and 2,8-dimethylimidazo[1,2-b]pyridazin-6-ylboronic acid (65.0 mg, 0.30 mmol, 1.50 equiv) in a mixture of dioxane (5 mL) and water (1 mL) was added $K_3PO_4$ (145.0 mg, 0.60 mmol, 3.00 equiv) and $Pd(dppf)Cl_2{\cdot}CH_2Cl_2$ (18.0 mg, 0.02 mmol, 0.10 equiv). The reaction mixture was stirred for 4 h at 80° C. under a nitrogen atmosphere, then concentrated under reduced pressure to give a residue. The residue was purified by Prep-TLC/silica gel column chromatography, eluted with PE/EA (1:1), to afford tert-butyl 4-(4-{2,8-dimethylimidazo[1,2-b]pyridazin-6-yl}-2-methyl-1-benzofuran-7-amido) piperidine-1-carboxylate (100.0 mg, 86.8%) as an oil. LCMS (ES, m/z): 504 $[M+H]^+$.

Synthesis of Compound 282

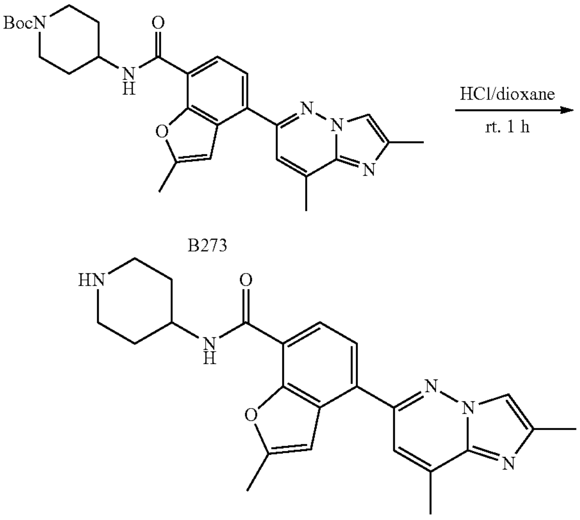

B273

282

A mixture of tert-butyl 4-(4-{2,8-dimethylimidazo[1,2-b]pyridazin-6-yl}-2-methyl-1-benzofuran-7-amido) piperidine-1-carboxylate (100.0 mg, 0.20 mmol, 1.00 equiv) and HCl/dioxane (1 mL) was stirred for 1 h at room temperature. The reaction mixture was concentrated under pressure to give a residue. The residue was purified by prep-HPLC (Condition 1, Gradient 18) to afford 4-{2,8-dimethylimidazo[1,2-b]pyridazin-6-yl}-2-methyl-N-(piperidin-4-yl)-1-benzofuran-7-carboxamide (10.6 mg, 13.3%) as a solid. LCMS (ES, m/z): 404 $[M+H]^+$. $^1$H-NMR (400 MHz, DMSO-$d_6$) δ 8.15 (d, J=7.9 Hz, 2H), 7.84 (d, J=8.0 Hz, 1H), 7.70-7.63 (m, 2H), 7.26 (d, J=1.3 Hz, 1H), 3.97-3.89 (m, 1H), 2.98 (dt, J=12.3, 3.7 Hz, 2H), 2.66-2.61 (m, 3H), 2.60-2.53 (m, 5H), 2.43 (s, 3H), 1.84 (dd, J=12.7, 3.8 Hz, 2H), 1.47 (qd, J=11.5, 4.0 Hz, 2H).

Example 38: Synthesis of Compound 280

Synthesis of Intermediate B274

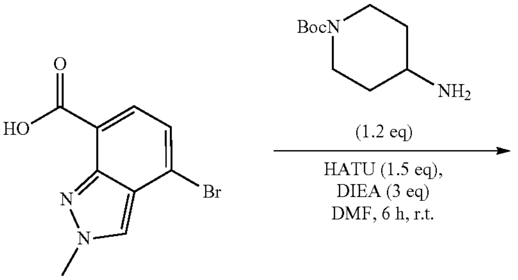

-continued

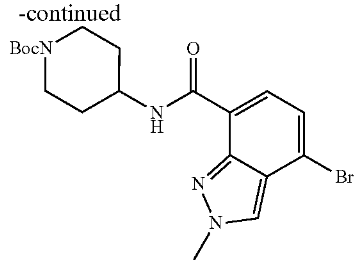

B274

To a stirred mixture of 4-bromo-2-methylindazole-7-carboxylic acid (650.00 mg, 2.55 mmol, 1.00 equiv) and tert-butyl 4-aminopiperidine-1-carboxylate (765.57 mg, 3.82 mmol, 1.50 equiv) in DMF was added HATU (1453.42 mg, 3.82 mmol, 1.50 equiv) and DIEA (988.06 mg, 7.64 mmol, 3.00 equiv) in portions at room temperature. The resulting mixture was stirred for 8 h at room temperature. The resulting mixture was extracted with diethyl ether (3x20 mL). The combined organic layers were washed with saturated NaCl (aq) (1x20 mL), dried over anhydrous $Na_2SO_4$, and filtered. After filtration, the filtrate was concentrated under reduced pressure to give a residue. The residue was purified by silica gel column chromatography, eluted with PE/EA (1:01), to afford tert-butyl 4-(4-bromo-2-methylindazole-7-amido)piperidine-1-carboxylate (700.00 mg, 62.81%) as a solid. LCMS (ES, m/z): 437 $[M+H]^+$.

Synthesis of Intermediate B275

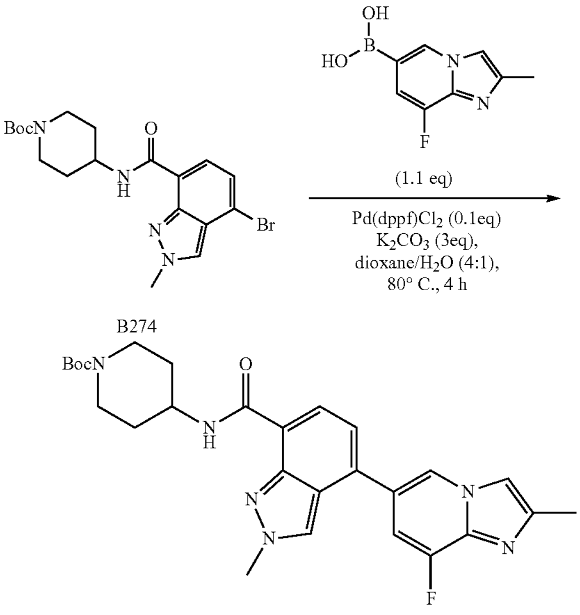

B274

B275

To a stirred mixture of tert-butyl 4-(4-bromo-2-methylindazole-7-amido)piperidine-1-carboxylate (200.00 mg, 0.46 mmol, 1.00 equiv) and 8-fluoro-2-methylimidazo[1,2-a]pyridin-6-ylboronic acid (133.06 mg, 0.69 mmol, 1.50 equiv) in dioxane/$H_2O$ (4:1) was added Pd(dppf)$Cl_2$·$CH_2Cl_2$ (37.25 mg, 0.05 mmol, 0.10 equiv) and $K_2CO_3$ (189.61 mg, 1.37 mmol, 3.00 equiv) in portions. The reaction mixture was stirred for 4 h at 80° C. under nitrogen atmosphere, then extracted with diethyl ether (3x10 mL). The combined organic layers were washed with saturated NaCl (aq) (1x10 mL), dried over anhydrous $Na_2SO_4$, and filtered. After filtration, the filtrate was concentrated under reduced pressure to give a residue. The residue was purified by silica gel column chromatography, eluted with $CH_2Cl_2$/MeOH (10:1), to afford tert-butyl 4-(4-{8-fluoro-2-methylimidazo[1,2-a]pyridin-6-yl}-2-methylindazole-7-amido)piperidine-1-carboxylate (120.00 mg, 51.80%) as a solid. LCMS (ES, m/z): 507 $[M+H]^+$ Synthesis of Compound 280

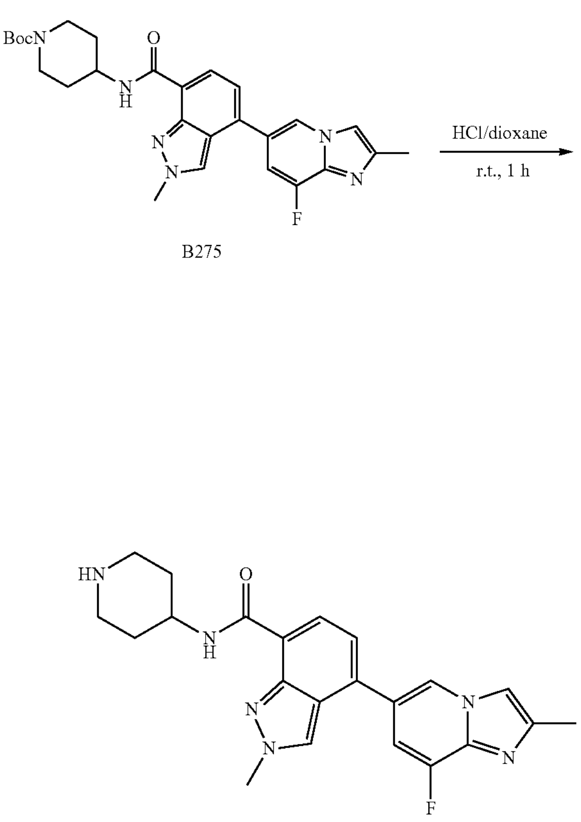

B275

280

A mixture of tert-butyl 4-(4-{8-fluoro-2-methylimidazo[1,2-a]pyridin-6-yl}-2-methylindazole-7-amido)piperidine-1-carboxylate (120.00 mg, 0.24 mmol, 1.00 equiv) and HCl/dioxane (5.00 mL) was stirred for 1 h at room temperature. The resulting mixture was concentrated under reduced pressure to give a residue. The residue was purified by Prep-HPLC (Condition 1, Gradient 18) to afford 4-{8-fluoro-2-methylimidazo[1,2-a]pyridin-6-yl}-2-methyl-N-(piperidin-4-yl)indazole-7-carboxamide (28.30 mg, 35.27%) as a solid. LCMS (ES, m/z): 407 $[M+H]^+$. $^1H$ NMR (400 MHz, DMSO-$d_6$) δ 9.19 (d, J=7.7 Hz, 1H), 8.93 (s, 1H), 8.83 (d, J=1.4 Hz, 1H), 8.08 (d, J=7.4 Hz, 1H), 7.90 (d, J=3.1 Hz, 1H), 7.53 (dd, J=12.2, 1.4 Hz, 1H), 7.42 (d, J=7.4 Hz, 1H), 4.30 (s, 3H), 4.01 (s, 1H), 2.98 (dt, J=12.6, 4.1 Hz, 2H), 2.67-2.56 (m, 2H), 2.41 (s, 3H), 1.96-1.87 (m, 2H), 1.47 (dd, J=10.3, 3.6 Hz, 2H).

Example 39: Synthesis of Compound 281

Synthesis of Intermediate B276

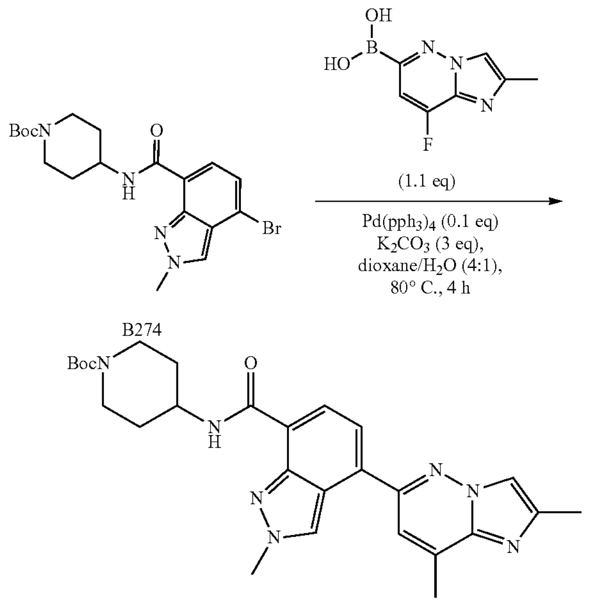

B274

B276

To a stirred mixture of tert-butyl 4-(4-bromo-2-methylindazole-7-amido) piperidine-1-carboxylate (200.00 mg, 0.46 mmol, 1.00 equiv) and 2,8-dimethylimidazo[1,2-b]pyridazin-6-ylboronic acid (131.02 mg, 0.69 mmol, 1.50 equiv) in dioxane/$H_2O$ (4:1, 5.00 ml) was added $Pd(PPh_3)_4$ (52.85 mg, 0.05 mmol, 0.10 equiv) and $K_2CO_3$ (189.61 mg, 1.37 mmol, 3.00 equiv) in portions. The reaction mixture was stirred at 80° C. under nitrogen atmosphere. The resulting mixture was extracted with diethyl ether (3×10 mL). The combined organic layers were washed with saturated NaCl aq (1×10 mL), dried over anhydrous $Na_2SO_4$, and filtered. After filtration, the filtrate was concentrated under reduced pressure to give a residue. The residue was purified by silica gel column chromatography, eluted with $CH_2Cl_2$/MeOH (10:01), to afford tert-butyl 4-(4-{2,8-dimethylimidazo[1,2-b]pyridazin-6-yl}-2-methylindazole-7-amido)piperidine-1-carboxylate (100 mg, 43.42%) as a solid. LCMS (ES, m/z): 504 $[M+H]^+$.

Synthesis of Compound 281

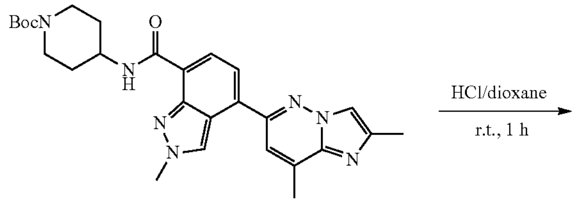

B276

-continued

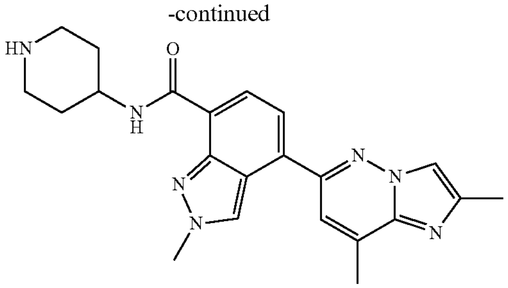

281

A mixture of tert-butyl 4-(4-{2,8-dimethylimidazo[1,2-b]pyridazin-6-yl}-2-methylindazole-7-amido)piperidine-1-carboxylate (120.00 mg, 0.24 mmol, 1.00 equiv) and HCl/dioxane (5.00 mL) was stirred for 1 h at room temperature. The resulting solution was concentrated under reduced pressure to give a residue. The residue was purified by Prep-HPLC (Condition 1, Gradient 18) to afford 4-{2,8-dimethylimidazo[1,2-b]pyridazin-6-yl}-2-methyl-N-(piperidin-4-yl)indazole-7-carboxamide (61.10 mg, 63.55%) as a solid. LCMS (ES, m/z): 404 $[M+H]^+$. $^1H$ NMR (400 MHz, DMSO-$d_6$) δ 9.26 (d, J=7.6 Hz, 1H), 9.16 (s, 1H), 8.15 (s, 1H), 8.11 (d, J=7.4 Hz, 1H), 7.90 (d, J=7.5 Hz, 1H), 7.79 (d, J=5.5 Hz, 1H), 4.33 (s, 3H), 4.02 (d, J=10.6 Hz, 1H), 2.98 (d, J=12.0 Hz, 2H), 2.65 (s, 1H), 2.54-2.48 (m, 4H), 2.44 (s, 3H), 1.92 (dd, J=12.8, 5.0 Hz, 2H), 1.52-1.38 (m, 2H).

Example 40: Synthesis of Compound 279

Synthesis of Intermediate B277

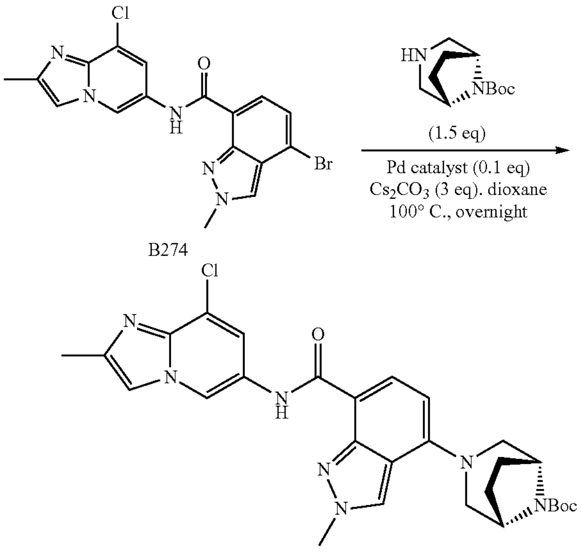

B274

B277

To a stirred mixture of 4-bromo-N-{8-chloro-2-methylimidazo[1,2-a]pyridin-6-yl}-2-methylindazole-7-carboxamide (100.00 mg, 0.24 mmol, 1.00 equiv) and tert-butyl (1R,5S)-3,8-diazabicyclo[3.2.1]octane-8-carboxylate (76.06 mg, 0.36 mmol, 1.50 equiv) in 1,4-dioxane was added RuPhos Palladacycle Gen.3 (19.98 mg, 0.02 mmol, 0.100 equiv) and $Cs_2CO_3$ (233.46 mg, 0.72 mmol, 3.00 equiv).

The reaction mixture was stirred for 10 h at 100° C. under nitrogen atmosphere, then extracted with diethyl ether (3×10 mL). The combined organic layers were washed with saturated NaCl (aq) (1×10 mL), dried over anhydrous $Na_2SO_4$, and filtered. After filtration, the filtrate was concentrated under reduced pressure to give a residue. The residue was purified by silica gel column chromatography, eluted with PE/EA (1:4), to afford tert-butyl (1R,5S)-3-[7-({8-chloro-2-methylimidazo[1,2-a]pyridin-6-yl}carbamoyl)-2-methylindazol-4-yl]-3,8-diazabicyclo[3.2.1]octane-8-carboxylate (60.00 mg, 45.67%) as a solid. LCMS (ES, m/z): 550 $[M+H]^+$.

Synthesis of Compound 279

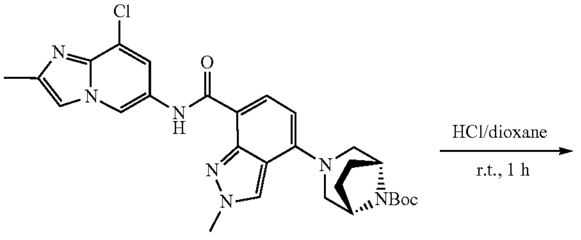

B277

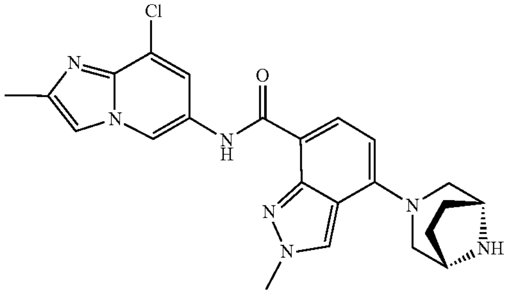

279

A solution of tert-butyl (1R,5S)-3-[7-({8-chloro-2-methylimidazo[1,2-a]pyridin-6-yl}carbamoyl)-2-methylindazol-4-yl]-3,8-diazabicyclo[3.2.1]octane-8-carboxylate (60.00 mg, 0.11 mmol, 1.00 equiv) in HCl/dioxane (10 mL) was stirred for 1 h at room temperature. The resulting mixture was concentrated under reduced pressure to give a residue. The residue was purified by prep-HPLC (Condition 9, Gradient 9) to afford N-{8-chloro-2-methylimidazo[1,2-a]pyridin-6-yl}-4-[(1R,5S)-3,8-diazabicyclo[3.2.1]octan-3-yl]-2-methylindazole-7-carboxamide (6.10 mg, 12.43%) as a solid. LCMS (ES, m/z): 450 $[M+H]^+$. $^1$H NMR (400 MHz, DMSO-$d_6$) δ 11.10 (s, 1H), 9.34 (d, J=1.8 Hz, 1H), 8.86 (s, 1H), 7.94 (d, J=8.3 Hz, 1H), 7.90 (s, 1H), 7.57 (d, J=1.7 Hz, 1H), 6.37 (d, J=8.4 Hz, 1H), 4.29 (s, 3H), 3.71 (dd, J=11.3, 2.3 Hz, 2H), 3.56 (s, 2H), 3.15 (dd, J=11.2, 2.3 Hz, 2H), 2.36 (s, 3H), 1.76 (dt, J=12.0, 8.2 Hz, 4H).

Example 41: Synthesis of Compound 287

Synthesis of Compound 287

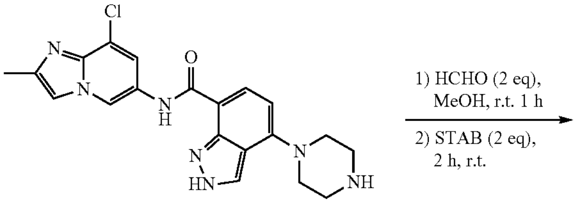

286

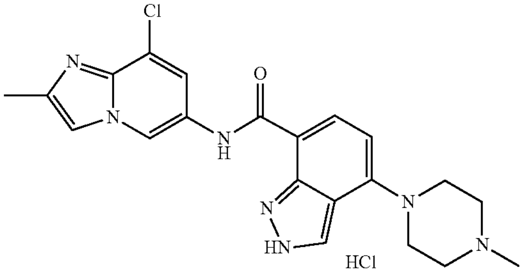

287

A mixture of N-{8-chloro-2-methylimidazo[1,2-a]pyridin-6-yl}-4-(piperazin-1-yl)-2H-indazole-7-carboxamide (80.00 mg, 0.20 mmol, 1.00 equiv) and formaldehyde (11.72 mg, 0.39 mmol, 2.00 equiv) in methanol (5 mL, 123.50 mmol, 632.72 equiv) was stirred for 1 h at room temperature. To the reaction mixture was added STAB (82.73 mg, 0.39 mmol, 2.00 equiv). The resulting mixture was stirred for an additional 2 h at room temperature, then extracted with ethyl acetate (3×10 mL). The combined organic layers were washed with saturated NaCl (1×10 mL), dried over anhydrous $Na_2SO_4$, and filtered. After filtration, the filtrate was concentrated under reduced pressure to give a residue. The residue was purified by prep-HPLC (Condition 6, Gradient 1, Gradient 2) to afford N-{8-chloro-2-methylimidazo[1,2-a]pyridin-6-yl}-4-(4-methyl-piperazin-1-yl)-2H-indazole-7-carboxamide (1.9 mg, 2.30%) as a solid. LCMS (ES, m/z): 424 $[M+H]^+$. $^1$H-NMR (400 MHz, DMSO-$d_6$) δ 13.12 (s, 1H), 11.25 (s, 1H), 11.05 (s, 1H), 9.56 (d, J=1.6 Hz, 1H), 8.56 (s, 1H), 8.39 (s, 1H), 8.36 (m, 1H), 8.27 (m, 1H), 6.68 (d, J=8.3 Hz, 1H), 4.12 (d, J=13.2 Hz, 2H), 3.44 (d, J=12.6 Hz, 3H), 3.44 (d, J=12.6 Hz, 4H) 3.30 (dt, J=12.7, 9.2 Hz, 2H), 2.86 (d, J=4.2 Hz, 3H).

Example 42: Exemplary Splicing Assay for Monitoring Expression Levels of Splice Variants Compounds described herein were used to modulate RNA transcript abundance in cells. The expression of a target mRNA was measured by detecting the formation of an exon-exon junction in the canonical transcript (CJ). A compound mediated exon-inclusion event was detected by observing an increase in formation of a new junction with an alternative exon (AJ). Real-time qPCR assays were used to detect these splicing switches and interrogate the potency of various compounds towards different target genes. A high-throughput real time quantitative PCR (RT-qPCR) assay was developed to measure these two isoforms of the mRNA (CJ and AJ) for an exemplary gene, HTT, together with a control housekeeping gene, GAPDH or GUSB or PPIA, used for normalization. Briefly, the A673 or K562 cell line was treated with various compounds described herein (e.g., compounds of Formula (I)). After treatment, the levels of the HTT mRNA targets were determined from each sample of cell lysate by cDNA synthesis followed by qPCR.

Materials

Cells-to-$C_T$ 1-step kit: ThermoFisher A25602, Cells-to-CT lysis reagent: ThermoFisher 4391851C, TaqMan™ Fast Virus 1-Step Master Mix: ThermoFisher 4444436

GAPDH: VIC-PL, ThermoFisher 4326317E (Assay: Hs99999905_m1)—used for K562/suspension cell lines GUSB: VIC-PL, ThermoFisher 4326320E (Assay: Hs99999908_m1)—used for K562/suspension cell lines PPIA: VIC-PL, ThermoFisher 4326316E (Assay: Hs99999904_m1)—used for A673/adherent cell lines Probe/Primer Sequences

```
Canonical junction (CJ)
HTT Primer 1:
                                (SEQ ID NO: 5528)
TCCTCCTGAGAAAGAGAAGGAC

HTT Primer 2:
                                (SEQ ID NO: 5529)
GCCTGGAGATCCAGACTCA

HTT CY5-Probe:
                                (SEQ ID NO: 5530)
/5Cy5/TGGCAACCCTTGAGGCCCTGTCCT/
3IAbRQSp/

Alternative junction (AJ)
HTT Primer 1:
                                (SEQ ID NO: 5531)
TCCTGAGAAAGAGAAGGACATTG

HTT Primer 2:
                                (SEQ ID NO: 5532)
CTGTGGGCTCCTGTAGAAATC

HTT FAM-Probe:
                                (SEQ ID NO: 5533)
/56-FAM/TGGCAACCC/ZEN/
TTGAGAGGCAAGCCCT/3IABKFQ/
```

Description

The A673 cell line was cultured in DMEM with 10% FBS. Cells were diluted with full growth media and plated in a 96-well plate (15,000 cells in 100 ul media per well). The plate was incubated at 37° C. with 5% $CO_2$ for 24 hours to allow cells to adhere. An 11-point 3-fold serial dilution of the compounds was made in DMSO then diluted in media in an intermediate plate. Compounds were transferred from the intermediate plate to the cell plate with the top dose at a final concentration of 10 uM in the well. Final DMSO concentration was kept at or below 0.25%. The cell plate was returned to the incubator at 37° C. with 5% $CO_2$ for an additional 24 hours.

The K562 cell line was cultured in IMDM with 10% FBS. For K562, cells were diluted with full growth media and plated in either a 96-well plate (50,000 cells in 50 uL media per well) or a 384-well plate (8,000-40,000 cells in 45 uL media per well). An 11-point 3-fold serial dilution of the compounds were made in DMSO then diluted in media in an intermediate plate. Compound was transferred from the intermediate plate to the cell plate with the top dose at a final concentration of 10 uM in the well. Final DMSO concentration was kept at or below 0.25%. Final volume was 100 uL for 96-well plate and 50 uL for 384-well plate. The cell plate was then placed in an incubator at 37° C. with 5% CO2 for 24 hours.

The cells were then gently washed with 50 uL-100 uL cold PBS before proceeding to addition of lysis buffer. 30 uL-50 μL of room temperature lysis buffer with DNAse I (and optionally RNAsin) was added to each well. Cells were shaken/mixed thoroughly at room temperature for 5-10 minutes for lysis to take place and then 3 uL-5 μL of room temperature stop solution was added and wells were shaken/mixed again. After 2-5 minutes, the cell lysate plate was transferred to ice for RT-qPCR reaction setup. The lysates could also be frozen at −80° C. for later use.

In some cases, a direct lysis buffer was used. An appropriate volume of 3× lysis buffer (10 mM Tris, 150 mM NaCl, 1.5%-2.5% Igepal and 0.1-1 U/uL RNAsin, pH 7.4) was directly added to either K562 or A673 cells in media and mixed by pipetting 3 times. The plates were then incubated at room temperature with shaking/rocking for 20-50 minutes to allow for lysis to take place. After this time, the cell lysate plate was transferred to ice to set up for the RT-qPCR reactions. The lysates could also be frozen at −80° C. for later use.

To set up 10 uL RT-qPCR reactions, cell lysates were transferred to 384-well qPCR plates containing the master mix according to the table below. The plates were sealed, gently vortexed, and spun down before the run. The volumes were adjusted accordingly in some instances where the reaction was carried in 20 μL. The table below summarizes the components of the RT-qPCR reactions:

| Component | 1X |
|---|---|
| Taqman 1-step RT-qPCR mix (4X) | 2.5 |
| 20X AJ Primers + Probe (FAM) | 0.5 |
| 20X CJ Primers + Probe (CY5) | 0.5 |
| 20X PPIA Control (VIC) | 0.5 |
| Cell lysate (1X) | 1-2 |
| $H_2O$ | 4-5 |
| Total volume | 10 |

The RT-qPCR reaction was performed using a QuantStudio (ThermoFisher) under the following fast cycling conditions. All samples and standards were analyzed at least in duplicate. In some instances, bulk room temperature (RT) step of 5-10 minutes was completed for all plates before proceeding with qPCR. The table below summarizes the PCR cycle:

| Step | # cycles | Temp. | Time |
|---|---|---|---|
| RT step | 1 | 50° C. | 5 min |
| RT inactivation/initial denaturation | 1 | 95° C. | 20 sec |
| Amplification | 40 | 95° C. | 3 sec |
| | | 60° C. | 30 sec |

The data analysis was performed by first determining the ΔCt vs the housekeeper gene. This ΔCt was then normalized against the DMSO control (ΔΔCt) and converted to RQ (relative quantification) using the 2^(−ΔΔCt) equation. The RQ were then converted to a percentage response by arbitrarily setting an assay window of 3.5 ΔCt for HTT-CJ and an assay window of 9 ΔCt for HTT-AJ. These assay windows correspond to the maximal modulation observed at high concentration of the most active compounds. The percentage response was then fitted to the 4 parametric logistic equation to evaluate the concentration dependence of compound treatment. The increase in AJ mRNA is reported as $AC_{50}$ (compound concentration having 50% response in AJ increase) while the decrease in CJ mRNA levels is reported as $IC_{50}$ (compound concentration having 50% response in CJ decrease).

A summary of these results is illustrated in Table 2, wherein "A" represents an $AC_{50}/IC_{50}$ of less than 100 nM; "B" represents an $AC_{50}/IC_{50}$ of between 100 nM and 1 μM; and "C" represents an $AC_{50}/IC_{50}$ of between 1 μM and 10 μM; and "D" represents an $AC_{50}/IC_{50}$ of greater than 10 μM.

TABLE 2

Modulation of RNA Splicing by Exemplary Compounds

| Compound No. | HTT AJ $AC_{50}$ (nM) | HTT CJ $AC_{50}$ (nM) |
|---|---|---|
| 118 | C | C |
| 119 | D | C |
| 140 | C | C |
| 141 | A | A |
| 142 | C | C |
| 143 | B | B |
| 145 | C | C |
| 148 | C | C |
| 149 | C | C |
| 187 | B | B |
| 188 | D | D |
| 189 | C | C |
| 190 | C | C |
| 191 | C | B |
| 193 | C | C |
| 194 | C | C |
| 196 | C | C |
| 197 | D | D |
| 198 | C | B |
| 199 | B | B |
| 200 | C | C |
| 201 | D | D |
| 202 | C | D |
| 203 | C | C |
| 204 | C | C |
| 205 | C | B |
| 206 | C | C |
| 207 | B | B |
| 208 | B | B |
| 209 | B | B |
| 210 | B | B |
| 211 | C | C |
| 212 | D | C |
| 217 | C | C |
| 218 | D | D |
| 219 | D | D |
| 228 | B | B |
| 229 | B | B |
| 230 | D | D |
| 231 | D | D |
| 234 | B | C |
| 235 | C | C |
| 238 | C | C |
| 239 | B | B |
| 240 | B | B |
| 241 | C | C |
| 242 | C | B |
| 243 | B | B |
| 244 | D | D |
| 245 | B | B |
| 246 | C | C |
| 247 | D | D |
| 249 | D | D |
| 250 | B | B |
| 251 | B | B |
| 252 | B | B |
| 253 | D | D |
| 255 | C | C |
| 256 | C | C |
| 257 | C | C |
| 258 | B | C |
| 259 | C | C |
| 260 | B | B |
| 261 | C | C |
| 262 | D | D |
| 263 | C | C |
| 264 | D | D |
| 265 | D | D |
| 266 | C | C |
| 267 | C | D |
| 268 | D | D |
| 269 | B | B |
| 270 | D | D |
| 271 | D | D |
| 272 | B | B |
| 273 | D | D |
| 274 | D | C |
| 275 | C | C |
| 277 | B | B |
| 278 | C | C |
| 279 | C | C |
| 280 | C | C |
| 281 | C | C |
| 282 | C | C |
| 283 | D | C |
| 284 | D | C |
| 285 | B | B |
| 286 | D | D |

Additional studies were carried out for a larger panel of genes using the protocol provided above. The junction between flanking upstream and downstream exons was used to design canonical junction qPCR assays. At least one of the forward primer, reverse primer or the CY5-labeled 5' nuclease probe (with 3' quencher such as ZEN/Iowa Black FQ) was designed to overlap with the exon junction to capture the CJ mRNA transcript. BLAST was used to confirm the specificity of the probeset and parameters such as melting temperature, GC content, amplicon size, and primer dimer formation are considered during their design. Data for the decrease in CJ mRNA levels for three exemplary genes (HTT, SMN2, and Target C) analyzed in this panel are reported as $IC_{50}$ (compound concentration having 50% response in CJ decrease).

A summary of the results from the panel is illustrated in Table 3, wherein "A" represents an $IC_{50}$ of less than 100 nM; "B" represents an $IC_{50}$ of between 100 nM and 1 μM; and "C" represents an $IC_{50}$ of between 1 M and 10 μM; and "D" represents an $IC_{50}$ of greater than 10 μM.

TABLE 3

| Modulation of RNA Splicing by Exemplary Compounds | | | |
|---|---|---|---|
| Compound No. | HTT | SMN2 | Target C |
| 118 | C | — | D |
| 119 | C | B | D |
| 140 | C | B | — |
| 141 | A | A | B |
| 142 | C | A | B |
| 143 | B | A | A |
| 145 | C | A | B |
| 148 | C | B | C |
| 149 | C | A | D |
| 187 | B | A | B |
| 188 | D | B | C |
| 189 | C | A | C |
| 190 | C | B | C |
| 191 | B | A | C |
| 192 | C | A | C |
| 193 | C | A | D |
| 194 | C | A | D |
| 195 | D | A | D |
| 196 | C | A | C |
| 197 | D | B | D |
| 198 | B | A | C |
| 199 | B | A | C |
| 200 | C | A | C |
| 201 | D | C | D |
| 202 | D | A | D |
| 203 | C | B | C |
| 204 | C | A | C |
| 205 | B | A | C |
| 206 | C | A | D |
| 207 | B | A | C |
| 208 | B | A | C |
| 209 | B | D | C |
| 210 | B | A | C |
| 211 | C | A | D |
| 212 | C | B | D |
| 217 | C | C | D |
| 218 | D | A | D |
| 219 | D | B | D |
| 228 | B | A | B |
| 229 | B | A | C |
| 230 | D | D | D |
| 231 | D | D | D |
| 234 | C | A | C |
| 235 | C | A | D |
| 238 | C | A | D |
| 239 | B | A | C |
| 240 | B | A | C |
| 241 | C | A | C |
| 242 | B | A | C |
| 243 | B | A | C |
| 244 | D | B | D |
| 245 | B | A | B |
| 246 | C | A | D |
| 247 | D | D | D |
| 249 | D | A | D |
| 250 | B | A | C |
| 251 | B | A | C |
| 252 | B | A | B |
| 253 | D | C | D |

TABLE 3-continued

| Modulation of RNA Splicing by Exemplary Compounds | | | |
|---|---|---|---|
| Compound No. | HTT | SMN2 | Target C |
| 255 | C | A | D |
| 256 | C | A | D |
| 257 | C | A | D |
| 258 | C | A | C |
| 259 | C | A | C |
| 260 | B | A | D |
| 261 | C | C | D |
| 262 | D | A | D |
| 263 | C | A | C |
| 264 | D | D | D |
| 265 | D | C | D |
| 266 | C | A | D |
| 267 | D | A | D |
| 268 | D | D | D |
| 269 | B | A | C |
| 270 | D | D | D |
| 271 | D | B | D |
| 272 | B | A | B |
| 273 | D | A | D |
| 274 | C | A | D |
| 275 | C | A | D |
| 277 | B | A | C |
| 278 | C | A | C |
| 279 | C | A | D |
| 280 | C | C | D |
| 281 | C | B | C |

EQUIVALENTS AND SCOPE

This application refers to various issued patents, published patent applications, journal articles, and other publications, all of which are incorporated herein by reference. If there is a conflict between any of the incorporated references and the instant specification, the specification shall control. In addition, any particular embodiment of the present invention that falls within the prior art may be explicitly excluded from any one or more of the claims. Because such embodiments are deemed to be known to one of ordinary skill in the art, they may be excluded even if the exclusion is not set forth explicitly herein. Any particular embodiment of the invention can be excluded from any claim, for any reason, whether or not related to the existence of prior art.

Those skilled in the art will recognize or be able to ascertain using no more than routine experimentation many equivalents to the specific embodiments described herein. The scope of the present embodiments described herein is not intended to be limited to the above Description, FIGURES, or Examples but rather is as set forth in the appended claims. Those of ordinary skill in the art will appreciate that various changes and modifications to this description may be made without departing from the spirit or scope of the present invention, as defined in the following claims.

SEQUENCE LISTING (5527 sequences)

SEQ ID NO: 1 - RNA, 10 nt, Unknown
  source: /note="Description of Unknown: Exemplary gene or splice site sequence"
aaagcaaguu

SEQ ID NO: 2 - RNA, 10 nt, Unknown
  source: /note="Description of Unknown: Exemplary gene or splice site sequence"
aaaguaaaaa

SEQ ID NO: 3 - RNA, 10 nt, Unknown
  source: /note="Description of Unknown: Exemplary gene or splice site sequence"
aaaguaaaau

SEQ ID NO: 4 - RNA, 10 nt, Unknown
  source: /note="Description of Unknown: Exemplary gene or splice site sequence"
aaaguaaagu

SEQ ID NO: 5 - RNA, 10 nt, Unknown
  source: /note="Description of Unknown: Exemplary gene or splice site sequence"
aaaguaaaua

SEQ ID NO: 6 - RNA, 10 nt, Unknown
  source: /note="Description of Unknown: Exemplary gene or splice site sequence"
aaaguaaaug

SEQ ID NO: 7 - RNA, 10 nt, Unknown
  source: /note="Description of Unknown: Exemplary gene or splice site sequence"
aaaguaaauu

SEQ ID NO: 8 - RNA, 10 nt, Unknown
  source: /note="Description of Unknown: Exemplary gene or splice site sequence"
aaaguaacac

SEQ ID NO: 9 - RNA, 10 nt, Unknown
  source: /note="Description of Unknown: Exemplary gene or splice site sequence"
aaaguaacca

SEQ ID NO: 10 - RNA, 10 nt, Unknown
  source: /note="Description of Unknown: Exemplary gene or splice site sequence"
aaaguaacuu

SEQ ID NO: 11 - RNA, 10 nt, Unknown
  source: /note="Description of Unknown: Exemplary gene or splice site sequence"
aaaguaagaa

SEQ ID NO: 12 - RNA, 10 nt, Unknown
  source: /note="Description of Unknown: Exemplary gene or splice site sequence"
aaaguaagac

SEQ ID NO: 13 - RNA, 10 nt, Unknown
  source: /note="Description of Unknown: Exemplary gene or splice site sequence"
aaaguaagag

SEQ ID NO: 14 - RNA, 10 nt, Unknown
  source: /note="Description of Unknown: Exemplary gene or splice site sequence"
aaaguaagau

SEQ ID NO: 15 - RNA, 10 nt, Unknown
  source: /note="Description of Unknown: Exemplary gene or splice site sequence"
aaaguaagca

SEQ ID NO: 16 - RNA, 10 nt, Unknown
  source: /note="Description of Unknown: Exemplary gene or splice site sequence"
aaaguaagcc

SEQ ID NO: 17 - RNA, 10 nt, Unknown
  source: /note="Description of Unknown: Exemplary gene or splice site sequence"
aaaguaagcu

SEQ ID NO: 18 - RNA, 10 nt, Unknown
  source: /note="Description of Unknown: Exemplary gene or splice site sequence"
aaaguaagga

SEQ ID NO: 19 - RNA, 10 nt, Unknown
  source: /note="Description of Unknown: Exemplary gene or splice site sequence"
aaaguaaggg

SEQ ID NO: 20 - RNA, 10 nt, Unknown
  source: /note="Description of Unknown: Exemplary gene or splice site sequence"
aaaguaaggu

SEQ ID NO: 21 - RNA, 10 nt, Unknown
  source: /note="Description of Unknown: Exemplary gene or splice site sequence"
aaaguaagua

SEQ ID NO: 22 - RNA, 10 nt, Unknown
  source: /note="Description of Unknown: Exemplary gene or splice site sequence"
aaaguaaguc

SEQ ID NO: 23 - RNA, 10 nt, Unknown
  source: /note="Description of Unknown: Exemplary gene or splice site sequence"
aaaguaagug

SEQ ID NO: 24 - RNA, 10 nt, Unknown
  source: /note="Description of Unknown: Exemplary gene or splice site sequence"
aaaguaaguu

SEQ ID NO: 25 - RNA, 10 nt, Unknown
  source: /note="Description of Unknown: Exemplary gene or splice site sequence"
aaaguaaucu

SEQ ID NO: 26 - RNA, 10 nt, Unknown
  source: /note="Description of Unknown: Exemplary gene or splice site sequence"
aaaguaauua

SEQ ID NO: 27 - RNA, 10 nt, Unknown
  source: /note="Description of Unknown: Exemplary gene or splice site sequence"
aaaguacaaa

SEQ ID NO: 28 - RNA, 10 nt, Unknown
  source: /note="Description of Unknown: Exemplary gene or splice site sequence"
aaaguaccgg

SEQ ID NO: 29 - RNA, 10 nt, Unknown
  source: /note="Description of Unknown: Exemplary gene or splice site sequence"
aaaguacuag

SEQ ID NO: 30 - RNA, 10 nt, Unknown
  source: /note="Description of Unknown: Exemplary gene or splice site sequence"
aaaguacugg

SEQ ID NO: 31 - RNA, 10 nt, Unknown
  source: /note="Description of Unknown: Exemplary gene or splice site sequence"
aaaguacuuc

SEQ ID NO: 32 - RNA, 10 nt, Unknown
  source: /note="Description of Unknown: Exemplary gene or splice site sequence"
aaaguacuug

SEQ ID NO: 33 - RNA, 10 nt, Unknown
  source: /note="Description of Unknown: Exemplary gene or splice site sequence"
aaaguagcuu

SEQ ID NO: 34 - RNA, 10 nt, Unknown
  source: /note="Description of Unknown: Exemplary gene or splice site sequence"
aaaguaggag

SEQ ID NO: 35 - RNA, 10 nt, Unknown
  source: /note="Description of Unknown: Exemplary gene or splice site sequence"
aaaguaggau

SEQ ID NO: 36 - RNA, 10 nt, Unknown
  source: /note="Description of Unknown: Exemplary gene or splice site sequence"
aaaguagggg

SEQ ID NO: 37 - RNA, 10 nt, Unknown
  source: /note="Description of Unknown: Exemplary gene or splice site sequence"
aaaguaggua

SEQ ID NO: 38 - RNA, 10 nt, Unknown
  source: /note="Description of Unknown: Exemplary gene or splice site sequence"
aaaguaguaa

SEQ ID NO: 39 - RNA, 10 nt, Unknown
  source: /note="Description of Unknown: Exemplary gene or splice site sequence"
aaaguauauu

SEQ ID NO: 40 - RNA, 10 nt, Unknown
  source: /note="Description of Unknown: Exemplary gene or splice site sequence"
aaaguauccu

SEQ ID NO: 41 - RNA, 10 nt, Unknown
  source: /note="Description of Unknown: Exemplary gene or splice site sequence"
aaaguaucuc

SEQ ID NO: 42 - RNA, 10 nt, Unknown
  source: /note="Description of Unknown: Exemplary gene or splice site sequence"
aaaguaugga

SEQ ID NO: 43 - RNA, 10 nt, Unknown
  source: /note="Description of Unknown: Exemplary gene or splice site sequence"
aaaguaugua

SEQ ID NO: 44 - RNA, 10 nt, Unknown
  source: /note="Description of Unknown: Exemplary gene or splice site sequence"
aaaguaugug

SEQ ID NO: 45 - RNA, 10 nt, Unknown
  source: /note="Description of Unknown: Exemplary gene or splice site sequence"
aaaguauguu

SEQ ID NO: 46 - RNA, 10 nt, Unknown
  source: /note="Description of Unknown: Exemplary gene or splice site sequence"
aaaguauugg

SEQ ID NO: 47 - RNA, 10 nt, Unknown
  source: /note="Description of Unknown: Exemplary gene or splice site sequence"
aaaguauuuu

SEQ ID NO: 48 - RNA, 10 nt, Unknown
  source: /note="Description of Unknown: Exemplary gene or splice site sequence"
aaagucagau

SEQ ID NO: 49 - RNA, 10 nt, Unknown
  source: /note="Description of Unknown: Exemplary gene or splice site sequence"
aaagucugag

SEQ ID NO: 50 - RNA, 10 nt, Unknown
  source: /note="Description of Unknown: Exemplary gene or splice site sequence"
aaagugaaua

SEQ ID NO: 51 - RNA, 10 nt, Unknown
  source: /note="Description of Unknown: Exemplary gene or splice site sequence"
aaagugagaa

SEQ ID NO: 52 - RNA, 10 nt, Unknown
  source: /note="Description of Unknown: Exemplary gene or splice site sequence"
aaagugagac

SEQ ID NO: 53 - RNA, 10 nt, Unknown
  source: /note="Description of Unknown: Exemplary gene or splice site sequence"
aaagugagag

SEQ ID NO: 54 - RNA, 10 nt, Unknown
  source: /note="Description of Unknown: Exemplary gene or splice site sequence"
aaagugagau

SEQ ID NO: 55 - RNA, 10 nt, Unknown
  source: /note="Description of Unknown: Exemplary gene or splice site sequence"
aaagugagca

SEQ ID NO: 56 - RNA, 10 nt, Unknown
  source: /note="Description of Unknown: Exemplary gene or splice site sequence"
aaagugagcu

SEQ ID NO: 57 - RNA, 10 nt, Unknown
  source: /note="Description of Unknown: Exemplary gene or splice site sequence"
aaagugaggg

SEQ ID NO: 58 - RNA, 10 nt, Unknown
  source: /note="Description of Unknown: Exemplary gene or splice site sequence"
aaagugagua

SEQ ID NO: 59 - RNA, 10 nt, Unknown
  source: /note="Description of Unknown: Exemplary gene or splice site sequence"
aaagugaguc

SEQ ID NO: 60 - RNA, 10 nt, Unknown
  source: /note="Description of Unknown: Exemplary gene or splice site sequence"
aaagugagug

SEQ ID NO: 61 - RNA, 10 nt, Unknown
  source: /note="Description of Unknown: Exemplary gene or splice site sequence"
aaagugaguu

SEQ ID NO: 62 - RNA, 10 nt, Unknown
  source: /note="Description of Unknown: Exemplary gene or splice site sequence"
aaagugcguc

SEQ ID NO: 63 - RNA, 10 nt, Unknown
  source: /note="Description of Unknown: Exemplary gene or splice site sequence"
aaagugcuga

SEQ ID NO: 64 - RNA, 10 nt, Unknown
  source: /note="Description of Unknown: Exemplary gene or splice site sequence"
aaaguggguc

SEQ ID NO: 65 - RNA, 10 nt, Unknown
  source: /note="Description of Unknown: Exemplary gene or splice site sequence"
aaaguggguu

SEQ ID NO: 66 - RNA, 10 nt, Unknown
  source: /note="Description of Unknown: Exemplary gene or splice site sequence"
aaagugguaa

SEQ ID NO: 67 - RNA, 10 nt, Unknown
  source: /note="Description of Unknown: Exemplary gene or splice site sequence"
aaaguguaug

SEQ ID NO: 68 - RNA, 10 nt, Unknown
  source: /note="Description of Unknown: Exemplary gene or splice site sequence"
aaagugugug

SEQ ID NO: 69 - RNA, 10 nt, Unknown
  source: /note="Description of Unknown: Exemplary gene or splice site sequence"
aaaguguguu

SEQ ID NO: 70 - RNA, 10 nt, Unknown
  source: /note="Description of Unknown: Exemplary gene or splice site sequence"
aaaguuaagu

SEQ ID NO: 71 - RNA, 10 nt, Unknown
  source: /note="Description of Unknown: Exemplary gene or splice site sequence"
aaaguuacuu

SEQ ID NO: 72 - RNA, 10 nt, Unknown
  source: /note="Description of Unknown: Exemplary gene or splice site sequence"
aaaguuagug

SEQ ID NO: 73 - RNA, 10 nt, Unknown
  source: /note="Description of Unknown: Exemplary gene or splice site sequence"
aaaguuaugu

SEQ ID NO: 74 - RNA, 10 nt, Unknown
  source: /note="Description of Unknown: Exemplary gene or splice site sequence"
aaaguugagu

SEQ ID NO: 75 - RNA, 10 nt, Unknown
  source: /note="Description of Unknown: Exemplary gene or splice site sequence"
aaaguuugua

SEQ ID NO: 76 - RNA, 10 nt, Unknown
  source: /note="Description of Unknown: Exemplary gene or splice site sequence"
aacguaaaac

SEQ ID NO: 77 - RNA, 10 nt, Unknown
  source: /note="Description of Unknown: Exemplary gene or splice site sequence"
aacguaaagc

SEQ ID NO: 78 - RNA, 10 nt, Unknown
  source: /note="Description of Unknown: Exemplary gene or splice site sequence"
aacguaaagg

SEQ ID NO: 79 - RNA, 10 nt, Unknown
  source: /note="Description of Unknown: Exemplary gene or splice site sequence"
aacguaagca

SEQ ID NO: 80 - RNA, 10 nt, Unknown
  source: /note="Description of Unknown: Exemplary gene or splice site sequence"
aacguaaggg

SEQ ID NO: 81 - RNA, 10 nt, Unknown
  source: /note="Description of Unknown: Exemplary gene or splice site sequence"
aacguaaguc

SEQ ID NO: 82 - RNA, 10 nt, Unknown
  source: /note="Description of Unknown: Exemplary gene or splice site sequence"
aacguaagug

SEQ ID NO: 83 - RNA, 10 nt, Unknown
  source: /note="Description of Unknown: Exemplary gene or splice site sequence"
aacguaaugg

SEQ ID NO: 84 - RNA, 10 nt, Unknown
  source: /note="Description of Unknown: Exemplary gene or splice site sequence"
aacguaguga

SEQ ID NO: 85 - RNA, 10 nt, Unknown
  source: /note="Description of Unknown: Exemplary gene or splice site sequence"
aacguaugua

SEQ ID NO: 86 - RNA, 10 nt, Unknown
  source: /note="Description of Unknown: Exemplary gene or splice site sequence"
aacguauguu

SEQ ID NO: 87 - RNA, 10 nt, Unknown
  source: /note="Description of Unknown: Exemplary gene or splice site sequence"
aacgugagca

SEQ ID NO: 88 - RNA, 10 nt, Unknown
  source: /note="Description of Unknown: Exemplary gene or splice site sequence"
aacgugagga

SEQ ID NO: 89 - RNA, 10 nt, Unknown
  source: /note="Description of Unknown: Exemplary gene or splice site sequence"
aacgugauuu

SEQ ID NO: 90 - RNA, 10 nt, Unknown
  source: /note="Description of Unknown: Exemplary gene or splice site sequence"
aacgugggau

SEQ ID NO: 91 - RNA, 10 nt, Unknown
  source: /note="Description of Unknown: Exemplary gene or splice site sequence"
aacgugggua

SEQ ID NO: 92 - RNA, 10 nt, Unknown
  source: /note="Description of Unknown: Exemplary gene or splice site sequence"
aacguguguu

SEQ ID NO: 93 - RNA, 10 nt, Unknown
  source: /note="Description of Unknown: Exemplary gene or splice site sequence"
aacguuggua

SEQ ID NO: 94 - RNA, 10 nt, Unknown
  source: /note="Description of Unknown: Exemplary gene or splice site sequence"
aaggcaaauu

SEQ ID NO: 95 - RNA, 10 nt, Unknown
  source: /note="Description of Unknown: Exemplary gene or splice site sequence"
aaggcaagag

SEQ ID NO: 96 - RNA, 10 nt, Unknown
  source: /note="Description of Unknown: Exemplary gene or splice site sequence"
aaggcaagau

SEQ ID NO: 97 - RNA, 10 nt, Unknown
  source: /note="Description of Unknown: Exemplary gene or splice site sequence"
aaggcaagcc

SEQ ID NO: 98 - RNA, 10 nt, Unknown
  source: /note="Description of Unknown: Exemplary gene or splice site sequence"
aaggcaagga

SEQ ID NO: 99 - RNA, 10 nt, Unknown
  source: /note="Description of Unknown: Exemplary gene or splice site sequence"
aaggcaaggg

SEQ ID NO: 100 - RNA, 10 nt, Unknown
  source: /note="Description of Unknown: Exemplary gene or splice site sequence"
aaggcaagug

SEQ ID NO: 101 - RNA, 10 nt, Unknown
  source: /note="Description of Unknown: Exemplary gene or splice site sequence"
aaggcaaguu

SEQ ID NO: 102 - RNA, 10 nt, Unknown
  source: /note="Description of Unknown: Exemplary gene or splice site sequence"
aaggcacugc

SEQ ID NO: 103 - RNA, 10 nt, Unknown
  source: /note="Description of Unknown: Exemplary gene or splice site sequence"
aaggcagaaa

SEQ ID NO: 104 - RNA, 10 nt, Unknown
  source: /note="Description of Unknown: Exemplary gene or splice site sequence"
aaggcaggau

SEQ ID NO: 105 - RNA, 10 nt, Unknown
  source: /note="Description of Unknown: Exemplary gene or splice site sequence"
aaggcaggca

SEQ ID NO: 106 - RNA, 10 nt, Unknown
  source: /note="Description of Unknown: Exemplary gene or splice site sequence"
aaggcaggga

SEQ ID NO: 107 - RNA, 10 nt, Unknown
  source: /note="Description of Unknown: Exemplary gene or splice site sequence"
aaggcagggg

SEQ ID NO: 108 - RNA, 10 nt, Unknown
  source: /note="Description of Unknown: Exemplary gene or splice site sequence"
aaggcaggua

SEQ ID NO: 109 - RNA, 10 nt, Unknown
  source: /note="Description of Unknown: Exemplary gene or splice site sequence"
aaggcaggug

SEQ ID NO: 110 - RNA, 10 nt, Unknown
  source: /note="Description of Unknown: Exemplary gene or splice site sequence"
aaggcaucuc

SEQ ID NO: 111 - RNA, 10 nt, Unknown
  source: /note="Description of Unknown: Exemplary gene or splice site sequence"
aaggcaugcu

SEQ ID NO: 112 - RNA, 10 nt, Unknown
  source: /note="Description of Unknown: Exemplary gene or splice site sequence"
aaggcaugga

SEQ ID NO: 113 - RNA, 10 nt, Unknown
  source: /note="Description of Unknown: Exemplary gene or splice site sequence"
aaggcauguu

SEQ ID NO: 114 - RNA, 10 nt, Unknown
  source: /note="Description of Unknown: Exemplary gene or splice site sequence"
aaggcauuau

SEQ ID NO: 115 - RNA, 10 nt, Unknown
  source: /note="Description of Unknown: Exemplary gene or splice site sequence"
aaggcgagcu

SEQ ID NO: 116 - RNA, 10 nt, Unknown
  source: /note="Description of Unknown: Exemplary gene or splice site sequence"
aaggcgaguc

SEQ ID NO: 117 - RNA, 10 nt, Unknown
  source: /note="Description of Unknown: Exemplary gene or splice site sequence"
aaggcgaguu

SEQ ID NO: 118 - RNA, 10 nt, Unknown
  source: /note="Description of Unknown: Exemplary gene or splice site sequence"
aaggcuagcc

SEQ ID NO: 119 - RNA, 10 nt, Unknown
  source: /note="Description of Unknown: Exemplary gene or splice site sequence"
aagguaaaaa

SEQ ID NO: 120 - RNA, 10 nt, Unknown
  source: /note="Description of Unknown: Exemplary gene or splice site sequence"
aagguaaaac

SEQ ID NO: 121 - RNA, 10 nt, Unknown
  source: /note="Description of Unknown: Exemplary gene or splice site sequence"
aagguaaaag

SEQ ID NO: 122 - RNA, 10 nt, Unknown
  source: /note="Description of Unknown: Exemplary gene or splice site sequence"
aagguaaaau

SEQ ID NO: 123 - RNA, 10 nt, Unknown
  source: /note="Description of Unknown: Exemplary gene or splice site sequence"
aagguaaaca

SEQ ID NO: 124 - RNA, 10 nt, Unknown
  source: /note="Description of Unknown: Exemplary gene or splice site sequence"
aagguaaacc

SEQ ID NO: 125 - RNA, 10 nt, Unknown
  source: /note="Description of Unknown: Exemplary gene or splice site sequence"
aagguaaacu

SEQ ID NO: 126 - RNA, 10 nt, Unknown
  source: /note="Description of Unknown: Exemplary gene or splice site sequence"
aagguaaaga

SEQ ID NO: 127 - RNA, 10 nt, Unknown
  source: /note="Description of Unknown: Exemplary gene or splice site sequence"
aagguaaagc

SEQ ID NO: 128 - RNA, 10 nt, Unknown
  source: /note="Description of Unknown: Exemplary gene or splice site sequence"
aagguaaagg

SEQ ID NO: 129 - RNA, 10 nt, Unknown
  source: /note="Description of Unknown: Exemplary gene or splice site sequence"
aagguaaagu

SEQ ID NO: 130 - RNA, 10 nt, Unknown
  source: /note="Description of Unknown: Exemplary gene or splice site sequence"
aagguaaaua

SEQ ID NO: 131 - RNA, 10 nt, Unknown
  source: /note="Description of Unknown: Exemplary gene or splice site sequence"
aagguaaauc

SEQ ID NO: 132 - RNA, 10 nt, Unknown
  source: /note="Description of Unknown: Exemplary gene or splice site sequence"
aagguaaaug

SEQ ID NO: 133 - RNA, 10 nt, Unknown
  source: /note="Description of Unknown: Exemplary gene or splice site sequence"
aagguaaauu

SEQ ID NO: 134 - RNA, 10 nt, Unknown
  source: /note="Description of Unknown: Exemplary gene or splice site sequence"
aagguaacaa

SEQ ID NO: 135 - RNA, 10 nt, Unknown
  source: /note="Description of Unknown: Exemplary gene or splice site sequence"
aagguaacau

SEQ ID NO: 136 - RNA, 10 nt, Unknown
  source: /note="Description of Unknown: Exemplary gene or splice site sequence"
aagguaaccc

SEQ ID NO: 137 - RNA, 10 nt, Unknown
  source: /note="Description of Unknown: Exemplary gene or splice site sequence"
aagguaacua

SEQ ID NO: 138 - RNA, 10 nt, Unknown
  source: /note="Description of Unknown: Exemplary gene or splice site sequence"
aagguaacuc

SEQ ID NO: 139 - RNA, 10 nt, Unknown
  source: /note="Description of Unknown: Exemplary gene or splice site sequence"
aagguaacug

SEQ ID NO: 140 - RNA, 10 nt, Unknown
  source: /note="Description of Unknown: Exemplary gene or splice site sequence"
aagguaacuu

SEQ ID NO: 141 - RNA, 10 nt, Unknown
  source: /note="Description of Unknown: Exemplary gene or splice site sequence"
aagguaagaa

SEQ ID NO: 142 - RNA, 10 nt, Unknown
  source: /note="Description of Unknown: Exemplary gene or splice site sequence"
aagguaagac

SEQ ID NO: 143 - RNA, 10 nt, Unknown
  source: /note="Description of Unknown: Exemplary gene or splice site sequence"
aagguaagag

SEQ ID NO: 144 - RNA, 10 nt, Unknown
  source: /note="Description of Unknown: Exemplary gene or splice site sequence"
aagguaagau

SEQ ID NO: 145 - RNA, 10 nt, Unknown
  source: /note="Description of Unknown: Exemplary gene or splice site sequence"
aagguaagca

SEQ ID NO: 146 - RNA, 10 nt, Unknown
  source: /note="Description of Unknown: Exemplary gene or splice site sequence"
aagguaagcc

SEQ ID NO: 147 - RNA, 10 nt, Unknown
  source: /note="Description of Unknown: Exemplary gene or splice site sequence"
aagguaagcg

SEQ ID NO: 148 - RNA, 10 nt, Unknown
  source: /note="Description of Unknown: Exemplary gene or splice site sequence"
aagguaagcu

SEQ ID NO: 149 - RNA, 10 nt, Unknown
  source: /note="Description of Unknown: Exemplary gene or splice site sequence"
aagguaagga

SEQ ID NO: 150 - RNA, 10 nt, Unknown
  source: /note="Description of Unknown: Exemplary gene or splice site sequence"
aagguaaggc

SEQ ID NO: 151 - RNA, 10 nt, Unknown
  source: /note="Description of Unknown: Exemplary gene or splice site sequence"
aagguaaggg

SEQ ID NO: 152 - RNA, 10 nt, Unknown
  source: /note="Description of Unknown: Exemplary gene or splice site sequence"
aagguaaggu

SEQ ID NO: 153 - RNA, 10 nt, Unknown
  source: /note="Description of Unknown: Exemplary gene or splice site sequence"
aagguaagua

SEQ ID NO: 154 - RNA, 10 nt, Unknown
  source: /note="Description of Unknown: Exemplary gene or splice site sequence"
aagguaaguc

SEQ ID NO: 155 - RNA, 10 nt, Unknown
  source: /note="Description of Unknown: Exemplary gene or splice site sequence"
aagguaagug

SEQ ID NO: 156 - RNA, 10 nt, Unknown
  source: /note="Description of Unknown: Exemplary gene or splice site sequence"
aagguaaguu

SEQ ID NO: 157 - RNA, 10 nt, Unknown
  source: /note="Description of Unknown: Exemplary gene or splice site sequence"
aagguaauaa

SEQ ID NO: 158 - RNA, 10 nt, Unknown
  source: /note="Description of Unknown: Exemplary gene or splice site sequence"
aagguaauac

SEQ ID NO: 159 - RNA, 10 nt, Unknown
  source: /note="Description of Unknown: Exemplary gene or splice site sequence"
aagguaauag

SEQ ID NO: 160 - RNA, 10 nt, Unknown
  source: /note="Description of Unknown: Exemplary gene or splice site sequence"
aagguaauau

SEQ ID NO: 161 - RNA, 10 nt, Unknown
  source: /note="Description of Unknown: Exemplary gene or splice site sequence"
aagguaauca

SEQ ID NO: 162 - RNA, 10 nt, Unknown
  source: /note="Description of Unknown: Exemplary gene or splice site sequence"
aagguaaucc

SEQ ID NO: 163 - RNA, 10 nt, Unknown
  source: /note="Description of Unknown: Exemplary gene or splice site sequence"
aagguaaucu

SEQ ID NO: 164 - RNA, 10 nt, Unknown
  source: /note="Description of Unknown: Exemplary gene or splice site sequence"
aagguaauga

SEQ ID NO: 165 - RNA, 10 nt, Unknown
  source: /note="Description of Unknown: Exemplary gene or splice site sequence"
aagguaaugc

SEQ ID NO: 166 - RNA, 10 nt, Unknown
  source: /note="Description of Unknown: Exemplary gene or splice site sequence"
aagguaaugg

SEQ ID NO: 167 - RNA, 10 nt, Unknown
  source: /note="Description of Unknown: Exemplary gene or splice site sequence"
aagguaaugu

SEQ ID NO: 168 - RNA, 10 nt, Unknown
  source: /note="Description of Unknown: Exemplary gene or splice site sequence"
aagguaauua

SEQ ID NO: 169 - RNA, 10 nt, Unknown
  source: /note="Description of Unknown: Exemplary gene or splice site sequence"
aagguaauuc

SEQ ID NO: 170 - RNA, 10 nt, Unknown
  source: /note="Description of Unknown: Exemplary gene or splice site sequence"
aagguaauug

SEQ ID NO: 171 - RNA, 10 nt, Unknown
  source: /note="Description of Unknown: Exemplary gene or splice site sequence"
aagguaauuu

SEQ ID NO: 172 - RNA, 10 nt, Unknown
  source: /note="Description of Unknown: Exemplary gene or splice site sequence"
aagguacaaa

SEQ ID NO: 173 - RNA, 10 nt, Unknown
  source: /note="Description of Unknown: Exemplary gene or splice site sequence"
aagguacaag

SEQ ID NO: 174 - RNA, 10 nt, Unknown
  source: /note="Description of Unknown: Exemplary gene or splice site sequence"
aagguacaau

SEQ ID NO: 175 - RNA, 10 nt, Unknown
  source: /note="Description of Unknown: Exemplary gene or splice site sequence"
aagguacacc

SEQ ID NO: 176 - RNA, 10 nt, Unknown
  source: /note="Description of Unknown: Exemplary gene or splice site sequence"
aagguacacu

SEQ ID NO: 177 - RNA, 10 nt, Unknown
  source: /note="Description of Unknown: Exemplary gene or splice site sequence"
aagguacagg

SEQ ID NO: 178 - RNA, 10 nt, Unknown
  source: /note="Description of Unknown: Exemplary gene or splice site sequence"
aagguacagu

SEQ ID NO: 179 - RNA, 10 nt, Unknown
  source: /note="Description of Unknown: Exemplary gene or splice site sequence"
aagguacaua

SEQ ID NO: 180 - RNA, 10 nt, Unknown
  source: /note="Description of Unknown: Exemplary gene or splice site sequence"
aagguacaug

SEQ ID NO: 181 - RNA, 10 nt, Unknown
  source: /note="Description of Unknown: Exemplary gene or splice site sequence"
aagguacauu

SEQ ID NO: 182 - RNA, 10 nt, Unknown
  source: /note="Description of Unknown: Exemplary gene or splice site sequence"
aagguaccaa

SEQ ID NO: 183 - RNA, 10 nt, Unknown
  source: /note="Description of Unknown: Exemplary gene or splice site sequence"
aagguaccag

SEQ ID NO: 184 - RNA, 10 nt, Unknown
  source: /note="Description of Unknown: Exemplary gene or splice site sequence"
aagguaccca

SEQ ID NO: 185 - RNA, 10 nt, Unknown
  source: /note="Description of Unknown: Exemplary gene or splice site sequence"
aagguacccu

SEQ ID NO: 186 - RNA, 10 nt, Unknown
  source: /note="Description of Unknown: Exemplary gene or splice site sequence"
aagguaccuc

SEQ ID NO: 187 - RNA, 10 nt, Unknown
  source: /note="Description of Unknown: Exemplary gene or splice site sequence"
aagguaccug

SEQ ID NO: 188 - RNA, 10 nt, Unknown
  source: /note="Description of Unknown: Exemplary gene or splice site sequence"
aagguaccuu

SEQ ID NO: 189 - RNA, 10 nt, Unknown
  source: /note="Description of Unknown: Exemplary gene or splice site sequence"
aagguacgaa

SEQ ID NO: 190 - RNA, 10 nt, Unknown
  source: /note="Description of Unknown: Exemplary gene or splice site sequence"
aagguacggg

SEQ ID NO: 191 - RNA, 10 nt, Unknown
  source: /note="Description of Unknown: Exemplary gene or splice site sequence"
aagguacggu

SEQ ID NO: 192 - RNA, 10 nt, Unknown
  source: /note="Description of Unknown: Exemplary gene or splice site sequence"
aagguacguc

SEQ ID NO: 193 - RNA, 10 nt, Unknown
  source: /note="Description of Unknown: Exemplary gene or splice site sequence"
aagguacguu

SEQ ID NO: 194 - RNA, 10 nt, Unknown
  source: /note="Description of Unknown: Exemplary gene or splice site sequence"
aagguacuaa

SEQ ID NO: 195 - RNA, 10 nt, Unknown
  source: /note="Description of Unknown: Exemplary gene or splice site sequence"
aagguacuau

SEQ ID NO: 196 - RNA, 10 nt, Unknown
  source: /note="Description of Unknown: Exemplary gene or splice site sequence"
aagguacucu

SEQ ID NO: 197 - RNA, 10 nt, Unknown
  source: /note="Description of Unknown: Exemplary gene or splice site sequence"
aagguacuga

SEQ ID NO: 198 - RNA, 10 nt, Unknown
  source: /note="Description of Unknown: Exemplary gene or splice site sequence"
aagguacugc

SEQ ID NO: 199 - RNA, 10 nt, Unknown
  source: /note="Description of Unknown: Exemplary gene or splice site sequence"
aagguacugu

SEQ ID NO: 200 - RNA, 10 nt, Unknown
  source: /note="Description of Unknown: Exemplary gene or splice site sequence"
aagguacuuc

SEQ ID NO: 201 - RNA, 10 nt, Unknown
  source: /note="Description of Unknown: Exemplary gene or splice site sequence"
aagguacuug

SEQ ID NO: 202 - RNA, 10 nt, Unknown
  source: /note="Description of Unknown: Exemplary gene or splice site sequence"
aagguacuuu

SEQ ID NO: 203 - RNA, 10 nt, Unknown
  source: /note="Description of Unknown: Exemplary gene or splice site sequence"
aagguagaaa

SEQ ID NO: 204 - RNA, 10 nt, Unknown
  source: /note="Description of Unknown: Exemplary gene or splice site sequence"
aagguagaac

SEQ ID NO: 205 - RNA, 10 nt, Unknown
  source: /note="Description of Unknown: Exemplary gene or splice site sequence"
aagguagaca

SEQ ID NO: 206 - RNA, 10 nt, Unknown
  source: /note="Description of Unknown: Exemplary gene or splice site sequence"
aagguagacc

SEQ ID NO: 207 - RNA, 10 nt, Unknown
  source: /note="Description of Unknown: Exemplary gene or splice site sequence"
aagguagacu

SEQ ID NO: 208 - RNA, 10 nt, Unknown
  source: /note="Description of Unknown: Exemplary gene or splice site sequence"
aagguagagu

SEQ ID NO: 209 - RNA, 10 nt, Unknown
  source: /note="Description of Unknown: Exemplary gene or splice site sequence"
aagguagaua

SEQ ID NO: 210 - RNA, 10 nt, Unknown
  source: /note="Description of Unknown: Exemplary gene or splice site sequence"
aagguagcaa

SEQ ID NO: 211 - RNA, 10 nt, Unknown
  source: /note="Description of Unknown: Exemplary gene or splice site sequence"
aagguagcag

SEQ ID NO: 212 - RNA, 10 nt, Unknown
  source: /note="Description of Unknown: Exemplary gene or splice site sequence"
aagguagcca

SEQ ID NO: 213 - RNA, 10 nt, Unknown
  source: /note="Description of Unknown: Exemplary gene or splice site sequence"
aagguagccu

SEQ ID NO: 214 - RNA, 10 nt, Unknown
  source: /note="Description of Unknown: Exemplary gene or splice site sequence"
aagguagcua

SEQ ID NO: 215 - RNA, 10 nt, Unknown
  source: /note="Description of Unknown: Exemplary gene or splice site sequence"
aagguagcug

SEQ ID NO: 216 - RNA, 10 nt, Unknown
  source: /note="Description of Unknown: Exemplary gene or splice site sequence"
aagguagcuu

SEQ ID NO: 217 - RNA, 10 nt, Unknown
  source: /note="Description of Unknown: Exemplary gene or splice site sequence"
aagguaggaa

SEQ ID NO: 218 - RNA, 10 nt, Unknown
  source: /note="Description of Unknown: Exemplary gene or splice site sequence"
aagguaggag

SEQ ID NO: 219 - RNA, 10 nt, Unknown
  source: /note="Description of Unknown: Exemplary gene or splice site sequence"
aagguaggau

SEQ ID NO: 220 - RNA, 10 nt, Unknown
  source: /note="Description of Unknown: Exemplary gene or splice site sequence"
aagguaggca

SEQ ID NO: 221 - RNA, 10 nt, Unknown
  source: /note="Description of Unknown: Exemplary gene or splice site sequence"
aagguaggcc

SEQ ID NO: 222 - RNA, 10 nt, Unknown
  source: /note="Description of Unknown: Exemplary gene or splice site sequence"
aagguaggcu

SEQ ID NO: 223 - RNA, 10 nt, Unknown
  source: /note="Description of Unknown: Exemplary gene or splice site sequence"
aagguaggga

SEQ ID NO: 224 - RNA, 10 nt, Unknown
  source: /note="Description of Unknown: Exemplary gene or splice site sequence"
aagguagggc

SEQ ID NO: 225 - RNA, 10 nt, Unknown
  source: /note="Description of Unknown: Exemplary gene or splice site sequence"
aagguagggg

SEQ ID NO: 226 - RNA, 10 nt, Unknown
  source: /note="Description of Unknown: Exemplary gene or splice site sequence"
aagguagggu

SEQ ID NO: 227 - RNA, 10 nt, Unknown
  source: /note="Description of Unknown: Exemplary gene or splice site sequence"
aagguaggua

SEQ ID NO: 228 - RNA, 10 nt, Unknown
  source: /note="Description of Unknown: Exemplary gene or splice site sequence"
aagguagguc

SEQ ID NO: 229 - RNA, 10 nt, Unknown
  source: /note="Description of Unknown: Exemplary gene or splice site sequence"
aagguaggug

SEQ ID NO: 230 - RNA, 10 nt, Unknown
  source: /note="Description of Unknown: Exemplary gene or splice site sequence"
aagguagguu

SEQ ID NO: 231 - RNA, 10 nt, Unknown
  source: /note="Description of Unknown: Exemplary gene or splice site sequence"
aagguaguaa

SEQ ID NO: 232 - RNA, 10 nt, Unknown
  source: /note="Description of Unknown: Exemplary gene or splice site sequence"
aagguaguag

SEQ ID NO: 233 - RNA, 10 nt, Unknown
  source: /note="Description of Unknown: Exemplary gene or splice site sequence"
aagguagucu

SEQ ID NO: 234 - RNA, 10 nt, Unknown
  source: /note="Description of Unknown: Exemplary gene or splice site sequence"
aagguagugc

SEQ ID NO: 235 - RNA, 10 nt, Unknown
  source: /note="Description of Unknown: Exemplary gene or splice site sequence"
aagguagugg

SEQ ID NO: 236 - RNA, 10 nt, Unknown
  source: /note="Description of Unknown: Exemplary gene or splice site sequence"
aagguaguuc

SEQ ID NO: 237 - RNA, 10 nt, Unknown
  source: /note="Description of Unknown: Exemplary gene or splice site sequence"
aagguaguuu

SEQ ID NO: 238 - RNA, 10 nt, Unknown
  source: /note="Description of Unknown: Exemplary gene or splice site sequence"
aagguauaaa

SEQ ID NO: 239 - RNA, 10 nt, Unknown
  source: /note="Description of Unknown: Exemplary gene or splice site sequence"
aagguauaau

SEQ ID NO: 240 - RNA, 10 nt, Unknown
  source: /note="Description of Unknown: Exemplary gene or splice site sequence"
aagguauaca

SEQ ID NO: 241 - RNA, 10 nt, Unknown
  source: /note="Description of Unknown: Exemplary gene or splice site sequence"
aagguauacu

SEQ ID NO: 242 - RNA, 10 nt, Unknown
  source: /note="Description of Unknown: Exemplary gene or splice site sequence"
aagguauaua

SEQ ID NO: 243 - RNA, 10 nt, Unknown
  source: /note="Description of Unknown: Exemplary gene or splice site sequence"
aagguauauc

SEQ ID NO: 244 - RNA, 10 nt, Unknown
  source: /note="Description of Unknown: Exemplary gene or splice site sequence"
aagguauaug

SEQ ID NO: 245 - RNA, 10 nt, Unknown
  source: /note="Description of Unknown: Exemplary gene or splice site sequence"
aagguauauu

SEQ ID NO: 246 - RNA, 10 nt, Unknown
  source: /note="Description of Unknown: Exemplary gene or splice site sequence"
aagguaucac

SEQ ID NO: 247 - RNA, 10 nt, Unknown
  source: /note="Description of Unknown: Exemplary gene or splice site sequence"
aagguaucag

SEQ ID NO: 248 - RNA, 10 nt, Unknown
  source: /note="Description of Unknown: Exemplary gene or splice site sequence"
aagguauccc

SEQ ID NO: 249 - RNA, 10 nt, Unknown
  source: /note="Description of Unknown: Exemplary gene or splice site sequence"
aagguauccu

SEQ ID NO: 250 - RNA, 10 nt, Unknown
  source: /note="Description of Unknown: Exemplary gene or splice site sequence"
aagguaucuc

SEQ ID NO: 251 - RNA, 10 nt, Unknown
  source: /note="Description of Unknown: Exemplary gene or splice site sequence"
aagguaucug

SEQ ID NO: 252 - RNA, 10 nt, Unknown
  source: /note="Description of Unknown: Exemplary gene or splice site sequence"
aagguaucuu

SEQ ID NO: 253 - RNA, 10 nt, Unknown
  source: /note="Description of Unknown: Exemplary gene or splice site sequence"
aagguaugaa

SEQ ID NO: 254 - RNA, 10 nt, Unknown
  source: /note="Description of Unknown: Exemplary gene or splice site sequence"
aagguaugac

SEQ ID NO: 255 - RNA, 10 nt, Unknown
  source: /note="Description of Unknown: Exemplary gene or splice site sequence"
aagguaugag

SEQ ID NO: 256 - RNA, 10 nt, Unknown
  source: /note="Description of Unknown: Exemplary gene or splice site sequence"
aagguaugau

SEQ ID NO: 257 - RNA, 10 nt, Unknown
  source: /note="Description of Unknown: Exemplary gene or splice site sequence"
aagguaugca

SEQ ID NO: 258 - RNA, 10 nt, Unknown
  source: /note="Description of Unknown: Exemplary gene or splice site sequence"
aagguaugcc

SEQ ID NO: 259 - RNA, 10 nt, Unknown
  source: /note="Description of Unknown: Exemplary gene or splice site sequence"
aagguaugcu

SEQ ID NO: 260 - RNA, 10 nt, Unknown
  source: /note="Description of Unknown: Exemplary gene or splice site sequence"
aagguaugga

SEQ ID NO: 261 - RNA, 10 nt, Unknown
  source: /note="Description of Unknown: Exemplary gene or splice site sequence"
aagguauggc

SEQ ID NO: 262 - RNA, 10 nt, Unknown
  source: /note="Description of Unknown: Exemplary gene or splice site sequence"
aagguauggg

SEQ ID NO: 263 - RNA, 10 nt, Unknown
  source: /note="Description of Unknown: Exemplary gene or splice site sequence"
aagguaugua

SEQ ID NO: 264 - RNA, 10 nt, Unknown
  source: /note="Description of Unknown: Exemplary gene or splice site sequence"
aagguauguc

SEQ ID NO: 265 - RNA, 10 nt, Unknown
  source: /note="Description of Unknown: Exemplary gene or splice site sequence"
aagguaugug

SEQ ID NO: 266 - RNA, 10 nt, Unknown
  source: /note="Description of Unknown: Exemplary gene or splice site sequence"
aagguauguu

SEQ ID NO: 267 - RNA, 10 nt, Unknown
  source: /note="Description of Unknown: Exemplary gene or splice site sequence"
aagguauuaa

SEQ ID NO: 268 - RNA, 10 nt, Unknown
  source: /note="Description of Unknown: Exemplary gene or splice site sequence"
aagguauuac

SEQ ID NO: 269 - RNA, 10 nt, Unknown
  source: /note="Description of Unknown: Exemplary gene or splice site sequence"
aagguauuag

SEQ ID NO: 270 - RNA, 10 nt, Unknown
  source: /note="Description of Unknown: Exemplary gene or splice site sequence"
aagguauuau

SEQ ID NO: 271 - RNA, 10 nt, Unknown
  source: /note="Description of Unknown: Exemplary gene or splice site sequence"
aagguauucc

SEQ ID NO: 272 - RNA, 10 nt, Unknown
  source: /note="Description of Unknown: Exemplary gene or splice site sequence"
aagguauuga

SEQ ID NO: 273 - RNA, 10 nt, Unknown
  source: /note="Description of Unknown: Exemplary gene or splice site sequence"
aagguauugu

SEQ ID NO: 274 - RNA, 10 nt, Unknown
  source: /note="Description of Unknown: Exemplary gene or splice site sequence"
aagguauuua

SEQ ID NO: 275 - RNA, 10 nt, Unknown
  source: /note="Description of Unknown: Exemplary gene or splice site sequence"
aagguauuuc

SEQ ID NO: 276 - RNA, 10 nt, Unknown
  source: /note="Description of Unknown: Exemplary gene or splice site sequence"
aagguauuug

SEQ ID NO: 277 - RNA, 10 nt, Unknown
  source: /note="Description of Unknown: Exemplary gene or splice site sequence"
aagguauuuu

SEQ ID NO: 278 - RNA, 10 nt, Unknown
  source: /note="Description of Unknown: Exemplary gene or splice site sequence"
aaggucaaau

SEQ ID NO: 279 - RNA, 10 nt, Unknown
  source: /note="Description of Unknown: Exemplary gene or splice site sequence"
aaggucaaga

SEQ ID NO: 280 - RNA, 10 nt, Unknown
  source: /note="Description of Unknown: Exemplary gene or splice site sequence"
aaggucaagu

SEQ ID NO: 281 - RNA, 10 nt, Unknown
  source: /note="Description of Unknown: Exemplary gene or splice site sequence"
aaggucacag

SEQ ID NO: 282 - RNA, 10 nt, Unknown
  source: /note="Description of Unknown: Exemplary gene or splice site sequence"
aaggucagaa

SEQ ID NO: 283 - RNA, 10 nt, Unknown
  source: /note="Description of Unknown: Exemplary gene or splice site sequence"
aaggucagac

SEQ ID NO: 284 - RNA, 10 nt, Unknown
  source: /note="Description of Unknown: Exemplary gene or splice site sequence"
aaggucagag

SEQ ID NO: 285 - RNA, 10 nt, Unknown
  source: /note="Description of Unknown: Exemplary gene or splice site sequence"
aaggucagca

SEQ ID NO: 286 - RNA, 10 nt, Unknown
  source: /note="Description of Unknown: Exemplary gene or splice site sequence"
aaggucagcc

SEQ ID NO: 287 - RNA, 10 nt, Unknown
  source: /note="Description of Unknown: Exemplary gene or splice site sequence"
aaggucagcg

SEQ ID NO: 288 - RNA, 10 nt, Unknown
  source: /note="Description of Unknown: Exemplary gene or splice site sequence"
aaggucagcu

SEQ ID NO: 289 - RNA, 10 nt, Unknown
  source: /note="Description of Unknown: Exemplary gene or splice site sequence"
aaggucagga

SEQ ID NO: 290 - RNA, 10 nt, Unknown
  source: /note="Description of Unknown: Exemplary gene or splice site sequence"
aaggucaggc

SEQ ID NO: 291 - RNA, 10 nt, Unknown
  source: /note="Description of Unknown: Exemplary gene or splice site sequence"
aaggucaggg

SEQ ID NO: 292 - RNA, 10 nt, Unknown
  source: /note="Description of Unknown: Exemplary gene or splice site sequence"
aaggucaggu

SEQ ID NO: 293 - RNA, 10 nt, Unknown
  source: /note="Description of Unknown: Exemplary gene or splice site sequence"
aaggucagua

SEQ ID NO: 294 - RNA, 10 nt, Unknown
  source: /note="Description of Unknown: Exemplary gene or splice site sequence"
aaggucaguc

SEQ ID NO: 295 - RNA, 10 nt, Unknown
  source: /note="Description of Unknown: Exemplary gene or splice site sequence"
aaggucagug

SEQ ID NO: 296 - RNA, 10 nt, Unknown
  source: /note="Description of Unknown: Exemplary gene or splice site sequence"
aaggucaguu

SEQ ID NO: 297 - RNA, 10 nt, Unknown
  source: /note="Description of Unknown: Exemplary gene or splice site sequence"
aaggucauag

SEQ ID NO: 298 - RNA, 10 nt, Unknown
  source: /note="Description of Unknown: Exemplary gene or splice site sequence"
aaggucaucu

SEQ ID NO: 299 - RNA, 10 nt, Unknown
  source: /note="Description of Unknown: Exemplary gene or splice site sequence"
aagguccaca

SEQ ID NO: 300 - RNA, 10 nt, Unknown
  source: /note="Description of Unknown: Exemplary gene or splice site sequence"
aagguccaga

SEQ ID NO: 301 - RNA, 10 nt, Unknown
  source: /note="Description of Unknown: Exemplary gene or splice site sequence"
aagguccaua

SEQ ID NO: 302 - RNA, 10 nt, Unknown
  source: /note="Description of Unknown: Exemplary gene or splice site sequence"
aaggucccag

SEQ ID NO: 303 - RNA, 10 nt, Unknown
  source: /note="Description of Unknown: Exemplary gene or splice site sequence"
aaggucccuc

SEQ ID NO: 304 - RNA, 10 nt, Unknown
  source: /note="Description of Unknown: Exemplary gene or splice site sequence"
aagguccuuc

SEQ ID NO: 305 - RNA, 10 nt, Unknown
  source: /note="Description of Unknown: Exemplary gene or splice site sequence"
aaggucgagg

SEQ ID NO: 306 - RNA, 10 nt, Unknown
  source: /note="Description of Unknown: Exemplary gene or splice site sequence"
aaggucuaau

SEQ ID NO: 307 - RNA, 10 nt, Unknown
  source: /note="Description of Unknown: Exemplary gene or splice site sequence"
aaggucuacc

SEQ ID NO: 308 - RNA, 10 nt, Unknown
  source: /note="Description of Unknown: Exemplary gene or splice site sequence"
aaggucuaua

SEQ ID NO: 309 - RNA, 10 nt, Unknown
  source: /note="Description of Unknown: Exemplary gene or splice site sequence"
aaggucuccu

SEQ ID NO: 310 - RNA, 10 nt, Unknown
  source: /note="Description of Unknown: Exemplary gene or splice site sequence"
aaggucucug

SEQ ID NO: 311 - RNA, 10 nt, Unknown
  source: /note="Description of Unknown: Exemplary gene or splice site sequence"
aaggucucuu

SEQ ID NO: 312 - RNA, 10 nt, Unknown
  source: /note="Description of Unknown: Exemplary gene or splice site sequence"
aaggucugaa

SEQ ID NO: 313 - RNA, 10 nt, Unknown
  source: /note="Description of Unknown: Exemplary gene or splice site sequence"
aaggucugag

SEQ ID NO: 314 - RNA, 10 nt, Unknown
  source: /note="Description of Unknown: Exemplary gene or splice site sequence"
aaggucugga

SEQ ID NO: 315 - RNA, 10 nt, Unknown
  source: /note="Description of Unknown: Exemplary gene or splice site sequence"
aaggucuggg

SEQ ID NO: 316 - RNA, 10 nt, Unknown
  source: /note="Description of Unknown: Exemplary gene or splice site sequence"
aaggucugua

SEQ ID NO: 317 - RNA, 10 nt, Unknown
  source: /note="Description of Unknown: Exemplary gene or splice site sequence"
aaggucuguu

SEQ ID NO: 318 - RNA, 10 nt, Unknown
  source: /note="Description of Unknown: Exemplary gene or splice site sequence"
aaggucuucu

SEQ ID NO: 319 - RNA, 10 nt, Unknown
  source: /note="Description of Unknown: Exemplary gene or splice site sequence"
aaggucuuuu

SEQ ID NO: 320 - RNA, 10 nt, Unknown
  source: /note="Description of Unknown: Exemplary gene or splice site sequence"
aaggugaaac

SEQ ID NO: 321 - RNA, 10 nt, Unknown
  source: /note="Description of Unknown: Exemplary gene or splice site sequence"
aaggugaaag

SEQ ID NO: 322 - RNA, 10 nt, Unknown
  source: /note="Description of Unknown: Exemplary gene or splice site sequence"
aaggugaaau

SEQ ID NO: 323 - RNA, 10 nt, Unknown
  source: /note="Description of Unknown: Exemplary gene or splice site sequence"
aaggugaacu

SEQ ID NO: 324 - RNA, 10 nt, Unknown
  source: /note="Description of Unknown: Exemplary gene or splice site sequence"
aaggugaagc

SEQ ID NO: 325 - RNA, 10 nt, Unknown
  source: /note="Description of Unknown: Exemplary gene or splice site sequence"
aaggugaagg

SEQ ID NO: 326 - RNA, 10 nt, Unknown
  source: /note="Description of Unknown: Exemplary gene or splice site sequence"
aaggugaagu

SEQ ID NO: 327 - RNA, 10 nt, Unknown
  source: /note="Description of Unknown: Exemplary gene or splice site sequence"
aaggugaaua

SEQ ID NO: 328 - RNA, 10 nt, Unknown
  source: /note="Description of Unknown: Exemplary gene or splice site sequence"
aaggugaaug

SEQ ID NO: 329 - RNA, 10 nt, Unknown
  source: /note="Description of Unknown: Exemplary gene or splice site sequence"
aaggugaauu

SEQ ID NO: 330 - RNA, 10 nt, Unknown
  source: /note="Description of Unknown: Exemplary gene or splice site sequence"
aaggugacaa

SEQ ID NO: 331 - RNA, 10 nt, Unknown
  source: /note="Description of Unknown: Exemplary gene or splice site sequence"
aaggugacag

SEQ ID NO: 332 - RNA, 10 nt, Unknown
  source: /note="Description of Unknown: Exemplary gene or splice site sequence"
aaggugacau

SEQ ID NO: 333 - RNA, 10 nt, Unknown
  source: /note="Description of Unknown: Exemplary gene or splice site sequence"
aaggugacug

SEQ ID NO: 334 - RNA, 10 nt, Unknown
  source: /note="Description of Unknown: Exemplary gene or splice site sequence"
aaggugacuu

SEQ ID NO: 335 - RNA, 10 nt, Unknown
  source: /note="Description of Unknown: Exemplary gene or splice site sequence"
aaggugagaa

SEQ ID NO: 336 - RNA, 10 nt, Unknown
  source: /note="Description of Unknown: Exemplary gene or splice site sequence"
aaggugagac

SEQ ID NO: 337 - RNA, 10 nt, Unknown
  source: /note="Description of Unknown: Exemplary gene or splice site sequence"
aaggugagag

SEQ ID NO: 338 - RNA, 10 nt, Unknown
  source: /note="Description of Unknown: Exemplary gene or splice site sequence"
aaggugagau

SEQ ID NO: 339 - RNA, 10 nt, Unknown
  source: /note="Description of Unknown: Exemplary gene or splice site sequence"
aaggugagca

SEQ ID NO: 340 - RNA, 10 nt, Unknown
  source: /note="Description of Unknown: Exemplary gene or splice site sequence"
aaggugagcc

SEQ ID NO: 341 - RNA, 10 nt, Unknown
  source: /note="Description of Unknown: Exemplary gene or splice site sequence"
aaggugagcg

SEQ ID NO: 342 - RNA, 10 nt, Unknown
  source: /note="Description of Unknown: Exemplary gene or splice site sequence"
aaggugagcu

SEQ ID NO: 343 - RNA, 10 nt, Unknown
  source: /note="Description of Unknown: Exemplary gene or splice site sequence"
aaggugagga

SEQ ID NO: 344 - RNA, 10 nt, Unknown
  source: /note="Description of Unknown: Exemplary gene or splice site sequence"
aaggugaggc

SEQ ID NO: 345 - RNA, 10 nt, Unknown
  source: /note="Description of Unknown: Exemplary gene or splice site sequence"
aaggugaggg

SEQ ID NO: 346 - RNA, 10 nt, Unknown
  source: /note="Description of Unknown: Exemplary gene or splice site sequence"
aaggugaggu

SEQ ID NO: 347 - RNA, 10 nt, Unknown
  source: /note="Description of Unknown: Exemplary gene or splice site sequence"
aaggugagua

SEQ ID NO: 348 - RNA, 10 nt, Unknown
  source: /note="Description of Unknown: Exemplary gene or splice site sequence"
aaggugaguc

SEQ ID NO: 349 - RNA, 10 nt, Unknown
  source: /note="Description of Unknown: Exemplary gene or splice site sequence"
aaggugagug

SEQ ID NO: 350 - RNA, 10 nt, Unknown
  source: /note="Description of Unknown: Exemplary gene or splice site sequence"
aaggugaguu

SEQ ID NO: 351 - RNA, 10 nt, Unknown
  source: /note="Description of Unknown: Exemplary gene or splice site sequence"
aaggugauaa

SEQ ID NO: 352 - RNA, 10 nt, Unknown
  source: /note="Description of Unknown: Exemplary gene or splice site sequence"
aaggugauca

SEQ ID NO: 353 - RNA, 10 nt, Unknown
  source: /note="Description of Unknown: Exemplary gene or splice site sequence"
aaggugaucc

SEQ ID NO: 354 - RNA, 10 nt, Unknown
  source: /note="Description of Unknown: Exemplary gene or splice site sequence"
aaggugauga

SEQ ID NO: 355 - RNA, 10 nt, Unknown
  source: /note="Description of Unknown: Exemplary gene or splice site sequence"
aaggugaugc

SEQ ID NO: 356 - RNA, 10 nt, Unknown
  source: /note="Description of Unknown: Exemplary gene or splice site sequence"
aaggugaugu

SEQ ID NO: 357 - RNA, 10 nt, Unknown
  source: /note="Description of Unknown: Exemplary gene or splice site sequence"
aaggugauua

SEQ ID NO: 358 - RNA, 10 nt, Unknown
  source: /note="Description of Unknown: Exemplary gene or splice site sequence"
aaggugauug

SEQ ID NO: 359 - RNA, 10 nt, Unknown
  source: /note="Description of Unknown: Exemplary gene or splice site sequence"
aaggugauuu

SEQ ID NO: 360 - RNA, 10 nt, Unknown
  source: /note="Description of Unknown: Exemplary gene or splice site sequence"
aaggugcaca

SEQ ID NO: 361 - RNA, 10 nt, Unknown
  source: /note="Description of Unknown: Exemplary gene or splice site sequence"
aaggugcauc

SEQ ID NO: 362 - RNA, 10 nt, Unknown
  source: /note="Description of Unknown: Exemplary gene or splice site sequence"
aaggugcccu

SEQ ID NO: 363 - RNA, 10 nt, Unknown
  source: /note="Description of Unknown: Exemplary gene or splice site sequence"
aaggugccug

SEQ ID NO: 364 - RNA, 10 nt, Unknown
  source: /note="Description of Unknown: Exemplary gene or splice site sequence"
aaggugcgug

SEQ ID NO: 365 - RNA, 10 nt, Unknown
  source: /note="Description of Unknown: Exemplary gene or splice site sequence"
aaggugcguu

SEQ ID NO: 366 - RNA, 10 nt, Unknown
  source: /note="Description of Unknown: Exemplary gene or splice site sequence"
aaggugcucc

SEQ ID NO: 367 - RNA, 10 nt, Unknown
  source: /note="Description of Unknown: Exemplary gene or splice site sequence"
aaggugcuga

SEQ ID NO: 368 - RNA, 10 nt, Unknown
  source: /note="Description of Unknown: Exemplary gene or splice site sequence"
aaggugcugc

SEQ ID NO: 369 - RNA, 10 nt, Unknown
  source: /note="Description of Unknown: Exemplary gene or splice site sequence"
aaggugcugg

SEQ ID NO: 370 - RNA, 10 nt, Unknown
  source: /note="Description of Unknown: Exemplary gene or splice site sequence"
aaggugcuua

SEQ ID NO: 371 - RNA, 10 nt, Unknown
  source: /note="Description of Unknown: Exemplary gene or splice site sequence"
aaggugcuuu

SEQ ID NO: 372 - RNA, 10 nt, Unknown
  source: /note="Description of Unknown: Exemplary gene or splice site sequence"
aagguggaua

SEQ ID NO: 373 - RNA, 10 nt, Unknown
  source: /note="Description of Unknown: Exemplary gene or splice site sequence"
aagguggcua

SEQ ID NO: 374 - RNA, 10 nt, Unknown
  source: /note="Description of Unknown: Exemplary gene or splice site sequence"
aagguggcug

SEQ ID NO: 375 - RNA, 10 nt, Unknown
  source: /note="Description of Unknown: Exemplary gene or splice site sequence"
aagguggcuu

SEQ ID NO: 376 - RNA, 10 nt, Unknown
  source: /note="Description of Unknown: Exemplary gene or splice site sequence"
aaggugggaa

SEQ ID NO: 377 - RNA, 10 nt, Unknown
  source: /note="Description of Unknown: Exemplary gene or splice site sequence"
aaggugggag

SEQ ID NO: 378 - RNA, 10 nt, Unknown
  source: /note="Description of Unknown: Exemplary gene or splice site sequence"
aaggugggau

SEQ ID NO: 379 - RNA, 10 nt, Unknown
  source: /note="Description of Unknown: Exemplary gene or splice site sequence"
aaggugggca

SEQ ID NO: 380 - RNA, 10 nt, Unknown
  source: /note="Description of Unknown: Exemplary gene or splice site sequence"
aaggugggcc

SEQ ID NO: 381 - RNA, 10 nt, Unknown
  source: /note="Description of Unknown: Exemplary gene or splice site sequence"
aaggugggcg

SEQ ID NO: 382 - RNA, 10 nt, Unknown
  source: /note="Description of Unknown: Exemplary gene or splice site sequence"
aaggugggga

SEQ ID NO: 383 - RNA, 10 nt, Unknown
  source: /note="Description of Unknown: Exemplary gene or splice site sequence"
aagguggggu

SEQ ID NO: 384 - RNA, 10 nt, Unknown
  source: /note="Description of Unknown: Exemplary gene or splice site sequence"
aaggugggua

SEQ ID NO: 385 - RNA, 10 nt, Unknown
  source: /note="Description of Unknown: Exemplary gene or splice site sequence"
aaggugggug

SEQ ID NO: 386 - RNA, 10 nt, Unknown
  source: /note="Description of Unknown: Exemplary gene or splice site sequence"
aagguggguu

SEQ ID NO: 387 - RNA, 10 nt, Unknown
  source: /note="Description of Unknown: Exemplary gene or splice site sequence"
aaggugguaa

SEQ ID NO: 388 - RNA, 10 nt, Unknown
  source: /note="Description of Unknown: Exemplary gene or splice site sequence"
aaggugguac

SEQ ID NO: 389 - RNA, 10 nt, Unknown
  source: /note="Description of Unknown: Exemplary gene or splice site sequence"
aaggugguau

SEQ ID NO: 390 - RNA, 10 nt, Unknown
  source: /note="Description of Unknown: Exemplary gene or splice site sequence"
aagguggugg

SEQ ID NO: 391 - RNA, 10 nt, Unknown
  source: /note="Description of Unknown: Exemplary gene or splice site sequence"
aaggugguua

SEQ ID NO: 392 - RNA, 10 nt, Unknown
  source: /note="Description of Unknown: Exemplary gene or splice site sequence"
aaggugguuc

SEQ ID NO: 393 - RNA, 10 nt, Unknown
  source: /note="Description of Unknown: Exemplary gene or splice site sequence"
aaggugguuu

SEQ ID NO: 394 - RNA, 10 nt, Unknown
  source: /note="Description of Unknown: Exemplary gene or splice site sequence"
aagguguaag

SEQ ID NO: 395 - RNA, 10 nt, Unknown
  source: /note="Description of Unknown: Exemplary gene or splice site sequence"
aaggugucaa

SEQ ID NO: 396 - RNA, 10 nt, Unknown
  source: /note="Description of Unknown: Exemplary gene or splice site sequence"
aaggugucag

SEQ ID NO: 397 - RNA, 10 nt, Unknown
  source: /note="Description of Unknown: Exemplary gene or splice site sequence"
aaggugucug

SEQ ID NO: 398 - RNA, 10 nt, Unknown
  source: /note="Description of Unknown: Exemplary gene or splice site sequence"
aaggugugaa

SEQ ID NO: 399 - RNA, 10 nt, Unknown
  source: /note="Description of Unknown: Exemplary gene or splice site sequence"
aaggugugag

SEQ ID NO: 400 - RNA, 10 nt, Unknown
  source: /note="Description of Unknown: Exemplary gene or splice site sequence"
aaggugugca

SEQ ID NO: 401 - RNA, 10 nt, Unknown
  source: /note="Description of Unknown: Exemplary gene or splice site sequence"
aaggugugga

SEQ ID NO: 402 - RNA, 10 nt, Unknown
  source: /note="Description of Unknown: Exemplary gene or splice site sequence"
aagguguggu

SEQ ID NO: 403 - RNA, 10 nt, Unknown
  source: /note="Description of Unknown: Exemplary gene or splice site sequence"
aaggugugua

SEQ ID NO: 404 - RNA, 10 nt, Unknown
  source: /note="Description of Unknown: Exemplary gene or splice site sequence"
aagguguguc

SEQ ID NO: 405 - RNA, 10 nt, Unknown
  source: /note="Description of Unknown: Exemplary gene or splice site sequence"
aaggugugug

SEQ ID NO: 406 - RNA, 10 nt, Unknown
  source: /note="Description of Unknown: Exemplary gene or splice site sequence"
aagguguguu

SEQ ID NO: 407 - RNA, 10 nt, Unknown
  source: /note="Description of Unknown: Exemplary gene or splice site sequence"
aagguguucu

SEQ ID NO: 408 - RNA, 10 nt, Unknown
  source: /note="Description of Unknown: Exemplary gene or splice site sequence"
aagguguugc

SEQ ID NO: 409 - RNA, 10 nt, Unknown
  source: /note="Description of Unknown: Exemplary gene or splice site sequence"
aagguguugg

SEQ ID NO: 410 - RNA, 10 nt, Unknown
  source: /note="Description of Unknown: Exemplary gene or splice site sequence"
aagguguuug

SEQ ID NO: 411 - RNA, 10 nt, Unknown
  source: /note="Description of Unknown: Exemplary gene or splice site sequence"
aagguuaaaa

SEQ ID NO: 412 - RNA, 10 nt, Unknown
  source: /note="Description of Unknown: Exemplary gene or splice site sequence"
aagguuaaca

SEQ ID NO: 413 - RNA, 10 nt, Unknown
  source: /note="Description of Unknown: Exemplary gene or splice site sequence"
aagguuaagc

SEQ ID NO: 414 - RNA, 10 nt, Unknown
  source: /note="Description of Unknown: Exemplary gene or splice site sequence"
aagguuaauu

SEQ ID NO: 415 - RNA, 10 nt, Unknown
  source: /note="Description of Unknown: Exemplary gene or splice site sequence"
aagguuacau

SEQ ID NO: 416 - RNA, 10 nt, Unknown
  source: /note="Description of Unknown: Exemplary gene or splice site sequence"
aagguuagaa

SEQ ID NO: 417 - RNA, 10 nt, Unknown
  source: /note="Description of Unknown: Exemplary gene or splice site sequence"
aagguuagau

SEQ ID NO: 418 - RNA, 10 nt, Unknown
  source: /note="Description of Unknown: Exemplary gene or splice site sequence"
aagguuagca

SEQ ID NO: 419 - RNA, 10 nt, Unknown
  source: /note="Description of Unknown: Exemplary gene or splice site sequence"
aagguuagcc

SEQ ID NO: 420 - RNA, 10 nt, Unknown
  source: /note="Description of Unknown: Exemplary gene or splice site sequence"
aagguuagga

SEQ ID NO: 421 - RNA, 10 nt, Unknown
  source: /note="Description of Unknown: Exemplary gene or splice site sequence"
aagguuaggc

SEQ ID NO: 422 - RNA, 10 nt, Unknown
  source: /note="Description of Unknown: Exemplary gene or splice site sequence"
aagguuagua

SEQ ID NO: 423 - RNA, 10 nt, Unknown
  source: /note="Description of Unknown: Exemplary gene or splice site sequence"
aagguuaguc

SEQ ID NO: 424 - RNA, 10 nt, Unknown
  source: /note="Description of Unknown: Exemplary gene or splice site sequence"
aagguuagug

SEQ ID NO: 425 - RNA, 10 nt, Unknown
  source: /note="Description of Unknown: Exemplary gene or splice site sequence"
aagguuaguu

SEQ ID NO: 426 - RNA, 10 nt, Unknown
  source: /note="Description of Unknown: Exemplary gene or splice site sequence"
aagguuauag

SEQ ID NO: 427 - RNA, 10 nt, Unknown
  source: /note="Description of Unknown: Exemplary gene or splice site sequence"
aagguuauga

SEQ ID NO: 428 - RNA, 10 nt, Unknown
  source: /note="Description of Unknown: Exemplary gene or splice site sequence"
aagguucaaa

SEQ ID NO: 429 - RNA, 10 nt, Unknown
  source: /note="Description of Unknown: Exemplary gene or splice site sequence"
aagguucaag

SEQ ID NO: 430 - RNA, 10 nt, Unknown
  source: /note="Description of Unknown: Exemplary gene or splice site sequence"
aagguuccuu

SEQ ID NO: 431 - RNA, 10 nt, Unknown
  source: /note="Description of Unknown: Exemplary gene or splice site sequence"
aagguucggc

SEQ ID NO: 432 - RNA, 10 nt, Unknown
  source: /note="Description of Unknown: Exemplary gene or splice site sequence"
aagguucguu

SEQ ID NO: 433 - RNA, 10 nt, Unknown
  source: /note="Description of Unknown: Exemplary gene or splice site sequence"
aagguucuaa

SEQ ID NO: 434 - RNA, 10 nt, Unknown
  source: /note="Description of Unknown: Exemplary gene or splice site sequence"
aagguucuga

SEQ ID NO: 435 - RNA, 10 nt, Unknown
  source: /note="Description of Unknown: Exemplary gene or splice site sequence"
aagguucuua

SEQ ID NO: 436 - RNA, 10 nt, Unknown
  source: /note="Description of Unknown: Exemplary gene or splice site sequence"
aagguugaau

SEQ ID NO: 437 - RNA, 10 nt, Unknown
  source: /note="Description of Unknown: Exemplary gene or splice site sequence"
aagguugacu

SEQ ID NO: 438 - RNA, 10 nt, Unknown
  source: /note="Description of Unknown: Exemplary gene or splice site sequence"
aagguugagg

SEQ ID NO: 439 - RNA, 10 nt, Unknown
  source: /note="Description of Unknown: Exemplary gene or splice site sequence"
aagguugagu

SEQ ID NO: 440 - RNA, 10 nt, Unknown
  source: /note="Description of Unknown: Exemplary gene or splice site sequence"
aagguugaua

SEQ ID NO: 441 - RNA, 10 nt, Unknown
  source: /note="Description of Unknown: Exemplary gene or splice site sequence"
aagguugcac

SEQ ID NO: 442 - RNA, 10 nt, Unknown
  source: /note="Description of Unknown: Exemplary gene or splice site sequence"
aagguugcug

SEQ ID NO: 443 - RNA, 10 nt, Unknown
  source: /note="Description of Unknown: Exemplary gene or splice site sequence"
aagguuggaa

SEQ ID NO: 444 - RNA, 10 nt, Unknown
  source: /note="Description of Unknown: Exemplary gene or splice site sequence"
aagguuggca

SEQ ID NO: 445 - RNA, 10 nt, Unknown
  source: /note="Description of Unknown: Exemplary gene or splice site sequence"
aagguuggga

SEQ ID NO: 446 - RNA, 10 nt, Unknown
  source: /note="Description of Unknown: Exemplary gene or splice site sequence"
aagguugggg

SEQ ID NO: 447 - RNA, 10 nt, Unknown
  source: /note="Description of Unknown: Exemplary gene or splice site sequence"
aagguuggua

SEQ ID NO: 448 - RNA, 10 nt, Unknown
  source: /note="Description of Unknown: Exemplary gene or splice site sequence"
aagguugguc

SEQ ID NO: 449 - RNA, 10 nt, Unknown
  source: /note="Description of Unknown: Exemplary gene or splice site sequence"
aagguuggug

SEQ ID NO: 450 - RNA, 10 nt, Unknown
  source: /note="Description of Unknown: Exemplary gene or splice site sequence"
aagguugguu

SEQ ID NO: 451 - RNA, 10 nt, Unknown
  source: /note="Description of Unknown: Exemplary gene or splice site sequence"
aagguuguaa

SEQ ID NO: 452 - RNA, 10 nt, Unknown
  source: /note="Description of Unknown: Exemplary gene or splice site sequence"
aagguugucc

SEQ ID NO: 453 - RNA, 10 nt, Unknown
  source: /note="Description of Unknown: Exemplary gene or splice site sequence"
aagguugugc

SEQ ID NO: 454 - RNA, 10 nt, Unknown
  source: /note="Description of Unknown: Exemplary gene or splice site sequence"
aagguuguua

SEQ ID NO: 455 - RNA, 10 nt, Unknown
  source: /note="Description of Unknown: Exemplary gene or splice site sequence"
aagguuuacc

SEQ ID NO: 456 - RNA, 10 nt, Unknown
  source: /note="Description of Unknown: Exemplary gene or splice site sequence"
aagguuuaua

SEQ ID NO: 457 - RNA, 10 nt, Unknown
  source: /note="Description of Unknown: Exemplary gene or splice site sequence"
aagguuuauu

SEQ ID NO: 458 - RNA, 10 nt, Unknown
  source: /note="Description of Unknown: Exemplary gene or splice site sequence"
aagguuuccu

SEQ ID NO: 459 - RNA, 10 nt, Unknown
  source: /note="Description of Unknown: Exemplary gene or splice site sequence"
aagguuucgu

SEQ ID NO: 460 - RNA, 10 nt, Unknown
  source: /note="Description of Unknown: Exemplary gene or splice site sequence"
aagguuugag

SEQ ID NO: 461 - RNA, 10 nt, Unknown
  source: /note="Description of Unknown: Exemplary gene or splice site sequence"
aagguuugca

SEQ ID NO: 462 - RNA, 10 nt, Unknown
  source: /note="Description of Unknown: Exemplary gene or splice site sequence"
aagguuugcc

SEQ ID NO: 463 - RNA, 10 nt, Unknown
  source: /note="Description of Unknown: Exemplary gene or splice site sequence"
aagguuugcu

SEQ ID NO: 464 - RNA, 10 nt, Unknown
  source: /note="Description of Unknown: Exemplary gene or splice site sequence"
aagguuugga

SEQ ID NO: 465 - RNA, 10 nt, Unknown
  source: /note="Description of Unknown: Exemplary gene or splice site sequence"
aagguuuggu

SEQ ID NO: 466 - RNA, 10 nt, Unknown
  source: /note="Description of Unknown: Exemplary gene or splice site sequence"
aagguuugua

SEQ ID NO: 467 - RNA, 10 nt, Unknown
  source: /note="Description of Unknown: Exemplary gene or splice site sequence"
aagguuuguc

SEQ ID NO: 468 - RNA, 10 nt, Unknown
  source: /note="Description of Unknown: Exemplary gene or splice site sequence"
aagguuugug

SEQ ID NO: 469 - RNA, 10 nt, Unknown
  source: /note="Description of Unknown: Exemplary gene or splice site sequence"
aagguuuuaa

SEQ ID NO: 470 - RNA, 10 nt, Unknown
  source: /note="Description of Unknown: Exemplary gene or splice site sequence"
aagguuuuca

SEQ ID NO: 471 - RNA, 10 nt, Unknown
  source: /note="Description of Unknown: Exemplary gene or splice site sequence"
aagguuuucg

SEQ ID NO: 472 - RNA, 10 nt, Unknown
  source: /note="Description of Unknown: Exemplary gene or splice site sequence"
aagguuuugc

SEQ ID NO: 473 - RNA, 10 nt, Unknown
  source: /note="Description of Unknown: Exemplary gene or splice site sequence"
aagguuuugu

SEQ ID NO: 474 - RNA, 10 nt, Unknown
  source: /note="Description of Unknown: Exemplary gene or splice site sequence"
aagguuuuuu

SEQ ID NO: 475 - RNA, 10 nt, Unknown
  source: /note="Description of Unknown: Exemplary gene or splice site sequence"
aaugcaagua

SEQ ID NO: 476 - RNA, 10 nt, Unknown
  source: /note="Description of Unknown: Exemplary gene or splice site sequence"
aaugcaaguc

SEQ ID NO: 477 - RNA, 10 nt, Unknown
  source: /note="Description of Unknown: Exemplary gene or splice site sequence"
aauguaaaca

SEQ ID NO: 478 - RNA, 10 nt, Unknown
  source: /note="Description of Unknown: Exemplary gene or splice site sequence"
aauguaaaua

SEQ ID NO: 479 - RNA, 10 nt, Unknown
  source: /note="Description of Unknown: Exemplary gene or splice site sequence"
aauguaaauc

SEQ ID NO: 480 - RNA, 10 nt, Unknown
  source: /note="Description of Unknown: Exemplary gene or splice site sequence"
aauguaaaug

SEQ ID NO: 481 - RNA, 10 nt, Unknown
  source: /note="Description of Unknown: Exemplary gene or splice site sequence"
aauguaaauu

SEQ ID NO: 482 - RNA, 10 nt, Unknown
  source: /note="Description of Unknown: Exemplary gene or splice site sequence"
aauguaacua

SEQ ID NO: 483 - RNA, 10 nt, Unknown
  source: /note="Description of Unknown: Exemplary gene or splice site sequence"
aauguaagaa

SEQ ID NO: 484 - RNA, 10 nt, Unknown
  source: /note="Description of Unknown: Exemplary gene or splice site sequence"
aauguaagag

SEQ ID NO: 485 - RNA, 10 nt, Unknown
  source: /note="Description of Unknown: Exemplary gene or splice site sequence"
aauguaagau

SEQ ID NO: 486 - RNA, 10 nt, Unknown
  source: /note="Description of Unknown: Exemplary gene or splice site sequence"
aauguaagcc

SEQ ID NO: 487 - RNA, 10 nt, Unknown
  source: /note="Description of Unknown: Exemplary gene or splice site sequence"
aauguaagcu

SEQ ID NO: 488 - RNA, 10 nt, Unknown
  source: /note="Description of Unknown: Exemplary gene or splice site sequence"
aauguaagga

SEQ ID NO: 489 - RNA, 10 nt, Unknown
  source: /note="Description of Unknown: Exemplary gene or splice site sequence"
aauguaagua

SEQ ID NO: 490 - RNA, 10 nt, Unknown
  source: /note="Description of Unknown: Exemplary gene or splice site sequence"
aauguaaguc

SEQ ID NO: 491 - RNA, 10 nt, Unknown
  source: /note="Description of Unknown: Exemplary gene or splice site sequence"
aauguaagug

SEQ ID NO: 492 - RNA, 10 nt, Unknown
  source: /note="Description of Unknown: Exemplary gene or splice site sequence"
aauguaaguu

SEQ ID NO: 493 - RNA, 10 nt, Unknown
  source: /note="Description of Unknown: Exemplary gene or splice site sequence"
aauguaauca

SEQ ID NO: 494 - RNA, 10 nt, Unknown
  source: /note="Description of Unknown: Exemplary gene or splice site sequence"
aauguaauga

SEQ ID NO: 495 - RNA, 10 nt, Unknown
  source: /note="Description of Unknown: Exemplary gene or splice site sequence"
aauguaaugu

SEQ ID NO: 496 - RNA, 10 nt, Unknown
  source: /note="Description of Unknown: Exemplary gene or splice site sequence"
aauguacauc

SEQ ID NO: 497 - RNA, 10 nt, Unknown
  source: /note="Description of Unknown: Exemplary gene or splice site sequence"
aauguacaug

SEQ ID NO: 498 - RNA, 10 nt, Unknown
  source: /note="Description of Unknown: Exemplary gene or splice site sequence"
aauguacgau

SEQ ID NO: 499 - RNA, 10 nt, Unknown
  source: /note="Description of Unknown: Exemplary gene or splice site sequence"
aauguacgua

SEQ ID NO: 500 - RNA, 10 nt, Unknown
  source: /note="Description of Unknown: Exemplary gene or splice site sequence"
aauguacguc

SEQ ID NO: 501 - RNA, 10 nt, Unknown
  source: /note="Description of Unknown: Exemplary gene or splice site sequence"
aauguacgug

SEQ ID NO: 502 - RNA, 10 nt, Unknown
  source: /note="Description of Unknown: Exemplary gene or splice site sequence"
aauguacucu

SEQ ID NO: 503 - RNA, 10 nt, Unknown
  source: /note="Description of Unknown: Exemplary gene or splice site sequence"
aauguaggca

SEQ ID NO: 504 - RNA, 10 nt, Unknown
  source: /note="Description of Unknown: Exemplary gene or splice site sequence"
aauguagguu

SEQ ID NO: 505 - RNA, 10 nt, Unknown
  source: /note="Description of Unknown: Exemplary gene or splice site sequence"
aauguaucua

SEQ ID NO: 506 - RNA, 10 nt, Unknown
  source: /note="Description of Unknown: Exemplary gene or splice site sequence"
aauguaugaa

SEQ ID NO: 507 - RNA, 10 nt, Unknown
  source: /note="Description of Unknown: Exemplary gene or splice site sequence"
aauguaugua

SEQ ID NO: 508 - RNA, 10 nt, Unknown
  source: /note="Description of Unknown: Exemplary gene or splice site sequence"
aauguaugug

SEQ ID NO: 509 - RNA, 10 nt, Unknown
  source: /note="Description of Unknown: Exemplary gene or splice site sequence"
aauguauguu

SEQ ID NO: 510 - RNA, 10 nt, Unknown
  source: /note="Description of Unknown: Exemplary gene or splice site sequence"
aaugucagag

SEQ ID NO: 511 - RNA, 10 nt, Unknown
  source: /note="Description of Unknown: Exemplary gene or splice site sequence"
aaugucagau

SEQ ID NO: 512 - RNA, 10 nt, Unknown
  source: /note="Description of Unknown: Exemplary gene or splice site sequence"
aaugucagcu

SEQ ID NO: 513 - RNA, 10 nt, Unknown
  source: /note="Description of Unknown: Exemplary gene or splice site sequence"
aaugucagua

SEQ ID NO: 514 - RNA, 10 nt, Unknown
  source: /note="Description of Unknown: Exemplary gene or splice site sequence"
aaugucaguc

SEQ ID NO: 515 - RNA, 10 nt, Unknown
  source: /note="Description of Unknown: Exemplary gene or splice site sequence"
aaugucagug

SEQ ID NO: 516 - RNA, 10 nt, Unknown
  source: /note="Description of Unknown: Exemplary gene or splice site sequence"
aaugucaguu

SEQ ID NO: 517 - RNA, 10 nt, Unknown
  source: /note="Description of Unknown: Exemplary gene or splice site sequence"
aaugucggua

SEQ ID NO: 518 - RNA, 10 nt, Unknown
  source: /note="Description of Unknown: Exemplary gene or splice site sequence"
aaugucuguu

SEQ ID NO: 519 - RNA, 10 nt, Unknown
  source: /note="Description of Unknown: Exemplary gene or splice site sequence"
aaugugagaa

SEQ ID NO: 520 - RNA, 10 nt, Unknown
  source: /note="Description of Unknown: Exemplary gene or splice site sequence"
aaugugagca

SEQ ID NO: 521 - RNA, 10 nt, Unknown
  source: /note="Description of Unknown: Exemplary gene or splice site sequence"
aaugugagcc

SEQ ID NO: 522 - RNA, 10 nt, Unknown
  source: /note="Description of Unknown: Exemplary gene or splice site sequence"
aaugugagga

SEQ ID NO: 523 - RNA, 10 nt, Unknown
  source: /note="Description of Unknown: Exemplary gene or splice site sequence"
aaugugagua

SEQ ID NO: 524 - RNA, 10 nt, Unknown
  source: /note="Description of Unknown: Exemplary gene or splice site sequence"
aaugugaguc

SEQ ID NO: 525 - RNA, 10 nt, Unknown
  source: /note="Description of Unknown: Exemplary gene or splice site sequence"
aaugugagug

SEQ ID NO: 526 - RNA, 10 nt, Unknown
  source: /note="Description of Unknown: Exemplary gene or splice site sequence"
aaugugaguu

SEQ ID NO: 527 - RNA, 10 nt, Unknown
  source: /note="Description of Unknown: Exemplary gene or splice site sequence"
aaugugauau

SEQ ID NO: 528 - RNA, 10 nt, Unknown
  source: /note="Description of Unknown: Exemplary gene or splice site sequence"
aaugugcaua

SEQ ID NO: 529 - RNA, 10 nt, Unknown
  source: /note="Description of Unknown: Exemplary gene or splice site sequence"
aaugugcgua

SEQ ID NO: 530 - RNA, 10 nt, Unknown
  source: /note="Description of Unknown: Exemplary gene or splice site sequence"
aaugugcguc

SEQ ID NO: 531 - RNA, 10 nt, Unknown
  source: /note="Description of Unknown: Exemplary gene or splice site sequence"
aaugugggac

SEQ ID NO: 532 - RNA, 10 nt, Unknown
  source: /note="Description of Unknown: Exemplary gene or splice site sequence"
aauguggguc

SEQ ID NO: 533 - RNA, 10 nt, Unknown
  source: /note="Description of Unknown: Exemplary gene or splice site sequence"
aaugugggug

SEQ ID NO: 534 - RNA, 10 nt, Unknown
  source: /note="Description of Unknown: Exemplary gene or splice site sequence"
aaugugguuu

SEQ ID NO: 535 - RNA, 10 nt, Unknown
  source: /note="Description of Unknown: Exemplary gene or splice site sequence"
aaugugugua

SEQ ID NO: 536 - RNA, 10 nt, Unknown
  source: /note="Description of Unknown: Exemplary gene or splice site sequence"
aauguuaagu

SEQ ID NO: 537 - RNA, 10 nt, Unknown
  source: /note="Description of Unknown: Exemplary gene or splice site sequence"
aauguuagaa

SEQ ID NO: 538 - RNA, 10 nt, Unknown
  source: /note="Description of Unknown: Exemplary gene or splice site sequence"
aauguuagau

SEQ ID NO: 539 - RNA, 10 nt, Unknown
  source: /note="Description of Unknown: Exemplary gene or splice site sequence"
aauguuagua

SEQ ID NO: 540 - RNA, 10 nt, Unknown
  source: /note="Description of Unknown: Exemplary gene or splice site sequence"
aauguuggug

SEQ ID NO: 541 - RNA, 10 nt, Unknown
  source: /note="Description of Unknown: Exemplary gene or splice site sequence"
acagcaagua

SEQ ID NO: 542 - RNA, 10 nt, Unknown
  source: /note="Description of Unknown: Exemplary gene or splice site sequence"
acaguaaaua

SEQ ID NO: 543 - RNA, 10 nt, Unknown
  source: /note="Description of Unknown: Exemplary gene or splice site sequence"
acaguaaaug

SEQ ID NO: 544 - RNA, 10 nt, Unknown
  source: /note="Description of Unknown: Exemplary gene or splice site sequence"
acaguaagaa

SEQ ID NO: 545 - RNA, 10 nt, Unknown
  source: /note="Description of Unknown: Exemplary gene or splice site sequence"
acaguaagca

SEQ ID NO: 546 - RNA, 10 nt, Unknown
  source: /note="Description of Unknown: Exemplary gene or splice site sequence"
acaguaagua

SEQ ID NO: 547 - RNA, 10 nt, Unknown
  source: /note="Description of Unknown: Exemplary gene or splice site sequence"
acaguaaguc

SEQ ID NO: 548 - RNA, 10 nt, Unknown
  source: /note="Description of Unknown: Exemplary gene or splice site sequence"
acaguaagug

SEQ ID NO: 549 - RNA, 10 nt, Unknown
  source: /note="Description of Unknown: Exemplary gene or splice site sequence"
acaguaaguu

SEQ ID NO: 550 - RNA, 10 nt, Unknown
  source: /note="Description of Unknown: Exemplary gene or splice site sequence"
acaguacgua

SEQ ID NO: 551 - RNA, 10 nt, Unknown
  source: /note="Description of Unknown: Exemplary gene or splice site sequence"
acaguaggug

SEQ ID NO: 552 - RNA, 10 nt, Unknown
  source: /note="Description of Unknown: Exemplary gene or splice site sequence"
acaguauaac

SEQ ID NO: 553 - RNA, 10 nt, Unknown
  source: /note="Description of Unknown: Exemplary gene or splice site sequence"
acaguaugua

SEQ ID NO: 554 - RNA, 10 nt, Unknown
  source: /note="Description of Unknown: Exemplary gene or splice site sequence"
acagucaguu

SEQ ID NO: 555 - RNA, 10 nt, Unknown
  source: /note="Description of Unknown: Exemplary gene or splice site sequence"
acagugagaa

SEQ ID NO: 556 - RNA, 10 nt, Unknown
  source: /note="Description of Unknown: Exemplary gene or splice site sequence"
acagugagcc

SEQ ID NO: 557 - RNA, 10 nt, Unknown
  source: /note="Description of Unknown: Exemplary gene or splice site sequence"
acagugagcu

SEQ ID NO: 558 - RNA, 10 nt, Unknown
  source: /note="Description of Unknown: Exemplary gene or splice site sequence"
acagugagga

SEQ ID NO: 559 - RNA, 10 nt, Unknown
  source: /note="Description of Unknown: Exemplary gene or splice site sequence"
acagugaggu

SEQ ID NO: 560 - RNA, 10 nt, Unknown
  source: /note="Description of Unknown: Exemplary gene or splice site sequence"
acagugagua

SEQ ID NO: 561 - RNA, 10 nt, Unknown
  source: /note="Description of Unknown: Exemplary gene or splice site sequence"
acagugaguc

SEQ ID NO: 562 - RNA, 10 nt, Unknown
  source: /note="Description of Unknown: Exemplary gene or splice site sequence"
acagugagug

SEQ ID NO: 563 - RNA, 10 nt, Unknown
  source: /note="Description of Unknown: Exemplary gene or splice site sequence"
acagugaguu

SEQ ID NO: 564 - RNA, 10 nt, Unknown
  source: /note="Description of Unknown: Exemplary gene or splice site sequence"
acagugggua

SEQ ID NO: 565 - RNA, 10 nt, Unknown
  source: /note="Description of Unknown: Exemplary gene or splice site sequence"
acaguggguu

SEQ ID NO: 566 - RNA, 10 nt, Unknown
  source: /note="Description of Unknown: Exemplary gene or splice site sequence"
acaguguaaa

SEQ ID NO: 567 - RNA, 10 nt, Unknown
  source: /note="Description of Unknown: Exemplary gene or splice site sequence"
acaguuaagc

SEQ ID NO: 568 - RNA, 10 nt, Unknown
  source: /note="Description of Unknown: Exemplary gene or splice site sequence"
acaguuaagu

SEQ ID NO: 569 - RNA, 10 nt, Unknown
  source: /note="Description of Unknown: Exemplary gene or splice site sequence"
acaguuaugu

SEQ ID NO: 570 - RNA, 10 nt, Unknown
  source: /note="Description of Unknown: Exemplary gene or splice site sequence"
acaguugagu

SEQ ID NO: 571 - RNA, 10 nt, Unknown
  source: /note="Description of Unknown: Exemplary gene or splice site sequence"
acaguuguga

SEQ ID NO: 572 - RNA, 10 nt, Unknown
  source: /note="Description of Unknown: Exemplary gene or splice site sequence"
accguaagua

SEQ ID NO: 573 - RNA, 10 nt, Unknown
  source: /note="Description of Unknown: Exemplary gene or splice site sequence"
accgugagaa

SEQ ID NO: 574 - RNA, 10 nt, Unknown
  source: /note="Description of Unknown: Exemplary gene or splice site sequence"
accgugagca

SEQ ID NO: 575 - RNA, 10 nt, Unknown
  source: /note="Description of Unknown: Exemplary gene or splice site sequence"
accgugaguu

SEQ ID NO: 576 - RNA, 10 nt, Unknown
  source: /note="Description of Unknown: Exemplary gene or splice site sequence"
accgugggug

SEQ ID NO: 577 - RNA, 10 nt, Unknown
  source: /note="Description of Unknown: Exemplary gene or splice site sequence"
acgguaaaac

SEQ ID NO: 578 - RNA, 10 nt, Unknown
  source: /note="Description of Unknown: Exemplary gene or splice site sequence"
acgguaacua

SEQ ID NO: 579 - RNA, 10 nt, Unknown
  source: /note="Description of Unknown: Exemplary gene or splice site sequence"
acgguaagua

SEQ ID NO: 580 - RNA, 10 nt, Unknown
  source: /note="Description of Unknown: Exemplary gene or splice site sequence"
acgguaagug

SEQ ID NO: 581 - RNA, 10 nt, Unknown
  source: /note="Description of Unknown: Exemplary gene or splice site sequence"
acgguaaguu

SEQ ID NO: 582 - RNA, 10 nt, Unknown
  source: /note="Description of Unknown: Exemplary gene or splice site sequence"
acgguaauua

SEQ ID NO: 583 - RNA, 10 nt, Unknown
  source: /note="Description of Unknown: Exemplary gene or splice site sequence"
acgguaauuu

SEQ ID NO: 584 - RNA, 10 nt, Unknown
  source: /note="Description of Unknown: Exemplary gene or splice site sequence"
acgguacaau

SEQ ID NO: 585 - RNA, 10 nt, Unknown
  source: /note="Description of Unknown: Exemplary gene or splice site sequence"
acgguacagu

SEQ ID NO: 586 - RNA, 10 nt, Unknown
  source: /note="Description of Unknown: Exemplary gene or splice site sequence"
acgguaccag

SEQ ID NO: 587 - RNA, 10 nt, Unknown
  source: /note="Description of Unknown: Exemplary gene or splice site sequence"
acgguacggu

SEQ ID NO: 588 - RNA, 10 nt, Unknown
  source: /note="Description of Unknown: Exemplary gene or splice site sequence"
acgguacgua

SEQ ID NO: 589 - RNA, 10 nt, Unknown
  source: /note="Description of Unknown: Exemplary gene or splice site sequence"
acgguaggaa

SEQ ID NO: 590 - RNA, 10 nt, Unknown
  source: /note="Description of Unknown: Exemplary gene or splice site sequence"
acgguaggag

SEQ ID NO: 591 - RNA, 10 nt, Unknown
  source: /note="Description of Unknown: Exemplary gene or splice site sequence"
acgguaggug

SEQ ID NO: 592 - RNA, 10 nt, Unknown
  source: /note="Description of Unknown: Exemplary gene or splice site sequence"
acgguaguaa

SEQ ID NO: 593 - RNA, 10 nt, Unknown
  source: /note="Description of Unknown: Exemplary gene or splice site sequence"
acgguauaau

SEQ ID NO: 594 - RNA, 10 nt, Unknown
  source: /note="Description of Unknown: Exemplary gene or splice site sequence"
acgguaugac

SEQ ID NO: 595 - RNA, 10 nt, Unknown
  source: /note="Description of Unknown: Exemplary gene or splice site sequence"
acgguaugcg

SEQ ID NO: 596 - RNA, 10 nt, Unknown
  source: /note="Description of Unknown: Exemplary gene or splice site sequence"
acgguaugua

SEQ ID NO: 597 - RNA, 10 nt, Unknown
  source: /note="Description of Unknown: Exemplary gene or splice site sequence"
acgguauguc

SEQ ID NO: 598 - RNA, 10 nt, Unknown
  source: /note="Description of Unknown: Exemplary gene or splice site sequence"
acggugaaac

SEQ ID NO: 599 - RNA, 10 nt, Unknown
  source: /note="Description of Unknown: Exemplary gene or splice site sequence"
acggugaagu

SEQ ID NO: 600 - RNA, 10 nt, Unknown
  source: /note="Description of Unknown: Exemplary gene or splice site sequence"
acggugaauc

SEQ ID NO: 601 - RNA, 10 nt, Unknown
  source: /note="Description of Unknown: Exemplary gene or splice site sequence"
acggugacag

SEQ ID NO: 602 - RNA, 10 nt, Unknown
  source: /note="Description of Unknown: Exemplary gene or splice site sequence"
acggugacca

SEQ ID NO: 603 - RNA, 10 nt, Unknown
  source: /note="Description of Unknown: Exemplary gene or splice site sequence"
acggugagaa

SEQ ID NO: 604 - RNA, 10 nt, Unknown
  source: /note="Description of Unknown: Exemplary gene or splice site sequence"
acggugagau

SEQ ID NO: 605 - RNA, 10 nt, Unknown
  source: /note="Description of Unknown: Exemplary gene or splice site sequence"
acggugagcc

SEQ ID NO: 606 - RNA, 10 nt, Unknown
  source: /note="Description of Unknown: Exemplary gene or splice site sequence"
acggugagua

SEQ ID NO: 607 - RNA, 10 nt, Unknown
  source: /note="Description of Unknown: Exemplary gene or splice site sequence"
acggugagug

SEQ ID NO: 608 - RNA, 10 nt, Unknown
  source: /note="Description of Unknown: Exemplary gene or splice site sequence"
acggugaguu

SEQ ID NO: 609 - RNA, 10 nt, Unknown
  source: /note="Description of Unknown: Exemplary gene or splice site sequence"
acggugcgug

SEQ ID NO: 610 - RNA, 10 nt, Unknown
  source: /note="Description of Unknown: Exemplary gene or splice site sequence"
acgguggcac

SEQ ID NO: 611 - RNA, 10 nt, Unknown
  source: /note="Description of Unknown: Exemplary gene or splice site sequence"
acgguggggc

SEQ ID NO: 612 - RNA, 10 nt, Unknown
  source: /note="Description of Unknown: Exemplary gene or splice site sequence"
acggugggug

SEQ ID NO: 613 - RNA, 10 nt, Unknown
  source: /note="Description of Unknown: Exemplary gene or splice site sequence"
acgguguagu

SEQ ID NO: 614 - RNA, 10 nt, Unknown
  source: /note="Description of Unknown: Exemplary gene or splice site sequence"
acggugucac

SEQ ID NO: 615 - RNA, 10 nt, Unknown
  source: /note="Description of Unknown: Exemplary gene or splice site sequence"
acggugugua

SEQ ID NO: 616 - RNA, 10 nt, Unknown
  source: /note="Description of Unknown: Exemplary gene or splice site sequence"
acgguguguu

SEQ ID NO: 617 - RNA, 10 nt, Unknown
  source: /note="Description of Unknown: Exemplary gene or splice site sequence"
acgguuagug

SEQ ID NO: 618 - RNA, 10 nt, Unknown
  source: /note="Description of Unknown: Exemplary gene or splice site sequence"
acgguuaguu

SEQ ID NO: 619 - RNA, 10 nt, Unknown
  source: /note="Description of Unknown: Exemplary gene or splice site sequence"
acgguucaau

SEQ ID NO: 620 - RNA, 10 nt, Unknown
  source: /note="Description of Unknown: Exemplary gene or splice site sequence"
acuguaaaua

SEQ ID NO: 621 - RNA, 10 nt, Unknown
  source: /note="Description of Unknown: Exemplary gene or splice site sequence"
acuguaagaa

SEQ ID NO: 622 - RNA, 10 nt, Unknown
  source: /note="Description of Unknown: Exemplary gene or splice site sequence"
acuguaagac

SEQ ID NO: 623 - RNA, 10 nt, Unknown
  source: /note="Description of Unknown: Exemplary gene or splice site sequence"
acuguaagca

SEQ ID NO: 624 - RNA, 10 nt, Unknown
  source: /note="Description of Unknown: Exemplary gene or splice site sequence"
acuguaagcu

SEQ ID NO: 625 - RNA, 10 nt, Unknown
  source: /note="Description of Unknown: Exemplary gene or splice site sequence"
acuguaagua

SEQ ID NO: 626 - RNA, 10 nt, Unknown
  source: /note="Description of Unknown: Exemplary gene or splice site sequence"
acuguaaguc

SEQ ID NO: 627 - RNA, 10 nt, Unknown
  source: /note="Description of Unknown: Exemplary gene or splice site sequence"
acuguaaguu

SEQ ID NO: 628 - RNA, 10 nt, Unknown
  source: /note="Description of Unknown: Exemplary gene or splice site sequence"
acuguacguu

SEQ ID NO: 629 - RNA, 10 nt, Unknown
  source: /note="Description of Unknown: Exemplary gene or splice site sequence"
acuguacugc

SEQ ID NO: 630 - RNA, 10 nt, Unknown
  source: /note="Description of Unknown: Exemplary gene or splice site sequence"
acuguaggcu

SEQ ID NO: 631 - RNA, 10 nt, Unknown
  source: /note="Description of Unknown: Exemplary gene or splice site sequence"
acuguaggua

SEQ ID NO: 632 - RNA, 10 nt, Unknown
  source: /note="Description of Unknown: Exemplary gene or splice site sequence"
acuguauauu

SEQ ID NO: 633 - RNA, 10 nt, Unknown
  source: /note="Description of Unknown: Exemplary gene or splice site sequence"
acuguaugaa

SEQ ID NO: 634 - RNA, 10 nt, Unknown
  source: /note="Description of Unknown: Exemplary gene or splice site sequence"
acuguaugcu

SEQ ID NO: 635 - RNA, 10 nt, Unknown
  source: /note="Description of Unknown: Exemplary gene or splice site sequence"
acuguaugug

SEQ ID NO: 636 - RNA, 10 nt, Unknown
  source: /note="Description of Unknown: Exemplary gene or splice site sequence"
acuguauucc

SEQ ID NO: 637 - RNA, 10 nt, Unknown
  source: /note="Description of Unknown: Exemplary gene or splice site sequence"
acugucagcu

SEQ ID NO: 638 - RNA, 10 nt, Unknown
  source: /note="Description of Unknown: Exemplary gene or splice site sequence"
acugucagug

SEQ ID NO: 639 - RNA, 10 nt, Unknown
  source: /note="Description of Unknown: Exemplary gene or splice site sequence"
acugugaacg

SEQ ID NO: 640 - RNA, 10 nt, Unknown
  source: /note="Description of Unknown: Exemplary gene or splice site sequence"
acugugagca

SEQ ID NO: 641 - RNA, 10 nt, Unknown
  source: /note="Description of Unknown: Exemplary gene or splice site sequence"
acugugagcg

SEQ ID NO: 642 - RNA, 10 nt, Unknown
  source: /note="Description of Unknown: Exemplary gene or splice site sequence"
acugugagcu

SEQ ID NO: 643 - RNA, 10 nt, Unknown
  source: /note="Description of Unknown: Exemplary gene or splice site sequence"
acugugagua

SEQ ID NO: 644 - RNA, 10 nt, Unknown
  source: /note="Description of Unknown: Exemplary gene or splice site sequence"
acugugaguc

SEQ ID NO: 645 - RNA, 10 nt, Unknown
  source: /note="Description of Unknown: Exemplary gene or splice site sequence"
acugugagug

SEQ ID NO: 646 - RNA, 10 nt, Unknown
  source: /note="Description of Unknown: Exemplary gene or splice site sequence"
acugugaguu

SEQ ID NO: 647 - RNA, 10 nt, Unknown
  source: /note="Description of Unknown: Exemplary gene or splice site sequence"
acugugggua

SEQ ID NO: 648 - RNA, 10 nt, Unknown
  source: /note="Description of Unknown: Exemplary gene or splice site sequence"
acugugugug

SEQ ID NO: 649 - RNA, 10 nt, Unknown
  source: /note="Description of Unknown: Exemplary gene or splice site sequence"
acuguuaagu

SEQ ID NO: 650 - RNA, 10 nt, Unknown
  source: /note="Description of Unknown: Exemplary gene or splice site sequence"
agagcaagua

SEQ ID NO: 651 - RNA, 10 nt, Unknown
  source: /note="Description of Unknown: Exemplary gene or splice site sequence"
agaguaaaac

SEQ ID NO: 652 - RNA, 10 nt, Unknown
  source: /note="Description of Unknown: Exemplary gene or splice site sequence"
agaguaaacg

SEQ ID NO: 653 - RNA, 10 nt, Unknown
  source: /note="Description of Unknown: Exemplary gene or splice site sequence"
agaguaaaga

SEQ ID NO: 654 - RNA, 10 nt, Unknown
  source: /note="Description of Unknown: Exemplary gene or splice site sequence"
agaguaaagu

SEQ ID NO: 655 - RNA, 10 nt, Unknown
  source: /note="Description of Unknown: Exemplary gene or splice site sequence"
agaguaaauc

SEQ ID NO: 656 - RNA, 10 nt, Unknown
  source: /note="Description of Unknown: Exemplary gene or splice site sequence"
agaguaaaug

SEQ ID NO: 657 - RNA, 10 nt, Unknown
  source: /note="Description of Unknown: Exemplary gene or splice site sequence"
agaguaacau

SEQ ID NO: 658 - RNA, 10 nt, Unknown
  source: /note="Description of Unknown: Exemplary gene or splice site sequence"
agaguaacua

SEQ ID NO: 659 - RNA, 10 nt, Unknown
  source: /note="Description of Unknown: Exemplary gene or splice site sequence"
agaguaagaa

SEQ ID NO: 660 - RNA, 10 nt, Unknown
  source: /note="Description of Unknown: Exemplary gene or splice site sequence"
agaguaagac

SEQ ID NO: 661 - RNA, 10 nt, Unknown
  source: /note="Description of Unknown: Exemplary gene or splice site sequence"
agaguaagag

SEQ ID NO: 662 - RNA, 10 nt, Unknown
  source: /note="Description of Unknown: Exemplary gene or splice site sequence"
agaguaagau

SEQ ID NO: 663 - RNA, 10 nt, Unknown
  source: /note="Description of Unknown: Exemplary gene or splice site sequence"
agaguaagca

SEQ ID NO: 664 - RNA, 10 nt, Unknown
  source: /note="Description of Unknown: Exemplary gene or splice site sequence"
agaguaagcu

SEQ ID NO: 665 - RNA, 10 nt, Unknown
  source: /note="Description of Unknown: Exemplary gene or splice site sequence"
agaguaagga

SEQ ID NO: 666 - RNA, 10 nt, Unknown
  source: /note="Description of Unknown: Exemplary gene or splice site sequence"
agaguaaggc

SEQ ID NO: 667 - RNA, 10 nt, Unknown
  source: /note="Description of Unknown: Exemplary gene or splice site sequence"
agaguaaggg

SEQ ID NO: 668 - RNA, 10 nt, Unknown
  source: /note="Description of Unknown: Exemplary gene or splice site sequence"
agaguaaggu

SEQ ID NO: 669 - RNA, 10 nt, Unknown
  source: /note="Description of Unknown: Exemplary gene or splice site sequence"
agaguaaguc

SEQ ID NO: 670 - RNA, 10 nt, Unknown
  source: /note="Description of Unknown: Exemplary gene or splice site sequence"
agaguaagug

SEQ ID NO: 671 - RNA, 10 nt, Unknown
  source: /note="Description of Unknown: Exemplary gene or splice site sequence"
agaguaaguu

SEQ ID NO: 672 - RNA, 10 nt, Unknown
  source: /note="Description of Unknown: Exemplary gene or splice site sequence"
agaguaauaa

SEQ ID NO: 673 - RNA, 10 nt, Unknown
  source: /note="Description of Unknown: Exemplary gene or splice site sequence"
agaguaaugu

SEQ ID NO: 674 - RNA, 10 nt, Unknown
  source: /note="Description of Unknown: Exemplary gene or splice site sequence"
agaguaauuc

SEQ ID NO: 675 - RNA, 10 nt, Unknown
  source: /note="Description of Unknown: Exemplary gene or splice site sequence"
agaguaauuu

SEQ ID NO: 676 - RNA, 10 nt, Unknown
  source: /note="Description of Unknown: Exemplary gene or splice site sequence"
agaguacacc

SEQ ID NO: 677 - RNA, 10 nt, Unknown
  source: /note="Description of Unknown: Exemplary gene or splice site sequence"
agaguaccug

SEQ ID NO: 678 - RNA, 10 nt, Unknown
  source: /note="Description of Unknown: Exemplary gene or splice site sequence"
agaguacgug

SEQ ID NO: 679 - RNA, 10 nt, Unknown
  source: /note="Description of Unknown: Exemplary gene or splice site sequence"
agaguacucu

SEQ ID NO: 680 - RNA, 10 nt, Unknown
  source: /note="Description of Unknown: Exemplary gene or splice site sequence"
agaguacuga

SEQ ID NO: 681 - RNA, 10 nt, Unknown
  source: /note="Description of Unknown: Exemplary gene or splice site sequence"
agaguacuuu

SEQ ID NO: 682 - RNA, 10 nt, Unknown
  source: /note="Description of Unknown: Exemplary gene or splice site sequence"
agaguagcug

SEQ ID NO: 683 - RNA, 10 nt, Unknown
  source: /note="Description of Unknown: Exemplary gene or splice site sequence"
agaguaggaa

SEQ ID NO: 684 - RNA, 10 nt, Unknown
  source: /note="Description of Unknown: Exemplary gene or splice site sequence"
agaguaggga

SEQ ID NO: 685 - RNA, 10 nt, Unknown
  source: /note="Description of Unknown: Exemplary gene or splice site sequence"
agaguagggu

SEQ ID NO: 686 - RNA, 10 nt, Unknown
  source: /note="Description of Unknown: Exemplary gene or splice site sequence"
agaguagguc

SEQ ID NO: 687 - RNA, 10 nt, Unknown
  source: /note="Description of Unknown: Exemplary gene or splice site sequence"
agaguaggug

SEQ ID NO: 688 - RNA, 10 nt, Unknown
  source: /note="Description of Unknown: Exemplary gene or splice site sequence"
agaguagguu

SEQ ID NO: 689 - RNA, 10 nt, Unknown
  source: /note="Description of Unknown: Exemplary gene or splice site sequence"
agaguauaua

SEQ ID NO: 690 - RNA, 10 nt, Unknown
  source: /note="Description of Unknown: Exemplary gene or splice site sequence"
agaguauauu

SEQ ID NO: 691 - RNA, 10 nt, Unknown
  source: /note="Description of Unknown: Exemplary gene or splice site sequence"
agaguaugaa

SEQ ID NO: 692 - RNA, 10 nt, Unknown
  source: /note="Description of Unknown: Exemplary gene or splice site sequence"
agaguaugac

SEQ ID NO: 693 - RNA, 10 nt, Unknown
  source: /note="Description of Unknown: Exemplary gene or splice site sequence"
agaguaugau

SEQ ID NO: 694 - RNA, 10 nt, Unknown
  source: /note="Description of Unknown: Exemplary gene or splice site sequence"
agaguauguc

SEQ ID NO: 695 - RNA, 10 nt, Unknown
  source: /note="Description of Unknown: Exemplary gene or splice site sequence"
agaguaugug

SEQ ID NO: 696 - RNA, 10 nt, Unknown
  source: /note="Description of Unknown: Exemplary gene or splice site sequence"
agaguauguu

SEQ ID NO: 697 - RNA, 10 nt, Unknown
  source: /note="Description of Unknown: Exemplary gene or splice site sequence"
agaguauuaa

SEQ ID NO: 698 - RNA, 10 nt, Unknown
  source: /note="Description of Unknown: Exemplary gene or splice site sequence"
agaguauuau

SEQ ID NO: 699 - RNA, 10 nt, Unknown
  source: /note="Description of Unknown: Exemplary gene or splice site sequence"
agagucagug

SEQ ID NO: 700 - RNA, 10 nt, Unknown
  source: /note="Description of Unknown: Exemplary gene or splice site sequence"
agagugagac

SEQ ID NO: 701 - RNA, 10 nt, Unknown
  source: /note="Description of Unknown: Exemplary gene or splice site sequence"
agagugagag

SEQ ID NO: 702 - RNA, 10 nt, Unknown
  source: /note="Description of Unknown: Exemplary gene or splice site sequence"
agagugagau

SEQ ID NO: 703 - RNA, 10 nt, Unknown
  source: /note="Description of Unknown: Exemplary gene or splice site sequence"
agagugagca

SEQ ID NO: 704 - RNA, 10 nt, Unknown
  source: /note="Description of Unknown: Exemplary gene or splice site sequence"
agagugagua

SEQ ID NO: 705 - RNA, 10 nt, Unknown
  source: /note="Description of Unknown: Exemplary gene or splice site sequence"
agagugaguc

SEQ ID NO: 706 - RNA, 10 nt, Unknown
  source: /note="Description of Unknown: Exemplary gene or splice site sequence"
agagugagug

SEQ ID NO: 707 - RNA, 10 nt, Unknown
  source: /note="Description of Unknown: Exemplary gene or splice site sequence"
agagugaguu

SEQ ID NO: 708 - RNA, 10 nt, Unknown
  source: /note="Description of Unknown: Exemplary gene or splice site sequence"
agagugcguc

SEQ ID NO: 709 - RNA, 10 nt, Unknown
  source: /note="Description of Unknown: Exemplary gene or splice site sequence"
agagugggga

SEQ ID NO: 710 - RNA, 10 nt, Unknown
  source: /note="Description of Unknown: Exemplary gene or splice site sequence"
agagugggug

SEQ ID NO: 711 - RNA, 10 nt, Unknown
  source: /note="Description of Unknown: Exemplary gene or splice site sequence"
agagugugug

SEQ ID NO: 712 - RNA, 10 nt, Unknown
  source: /note="Description of Unknown: Exemplary gene or splice site sequence"
agaguguuuc

SEQ ID NO: 713 - RNA, 10 nt, Unknown
  source: /note="Description of Unknown: Exemplary gene or splice site sequence"
agaguuagua

SEQ ID NO: 714 - RNA, 10 nt, Unknown
  source: /note="Description of Unknown: Exemplary gene or splice site sequence"
agaguugaga

SEQ ID NO: 715 - RNA, 10 nt, Unknown
  source: /note="Description of Unknown: Exemplary gene or splice site sequence"
agaguugagu

SEQ ID NO: 716 - RNA, 10 nt, Unknown
  source: /note="Description of Unknown: Exemplary gene or splice site sequence"
agaguugguu

SEQ ID NO: 717 - RNA, 10 nt, Unknown
  source: /note="Description of Unknown: Exemplary gene or splice site sequence"
agaguuugau

SEQ ID NO: 718 - RNA, 10 nt, Unknown
  source: /note="Description of Unknown: Exemplary gene or splice site sequence"
agcguaagcu

SEQ ID NO: 719 - RNA, 10 nt, Unknown
  source: /note="Description of Unknown: Exemplary gene or splice site sequence"
agcguaagug

SEQ ID NO: 720 - RNA, 10 nt, Unknown
  source: /note="Description of Unknown: Exemplary gene or splice site sequence"
agcgugagcc

SEQ ID NO: 721 - RNA, 10 nt, Unknown
  source: /note="Description of Unknown: Exemplary gene or splice site sequence"
agcgugagug

SEQ ID NO: 722 - RNA, 10 nt, Unknown
  source: /note="Description of Unknown: Exemplary gene or splice site sequence"
agcguuguuc

SEQ ID NO: 723 - RNA, 10 nt, Unknown
  source: /note="Description of Unknown: Exemplary gene or splice site sequence"
agggcagagu

SEQ ID NO: 724 - RNA, 10 nt, Unknown
  source: /note="Description of Unknown: Exemplary gene or splice site sequence"
agggcagccu

SEQ ID NO: 725 - RNA, 10 nt, Unknown
  source: /note="Description of Unknown: Exemplary gene or splice site sequence"
agggcuagua

SEQ ID NO: 726 - RNA, 10 nt, Unknown
  source: /note="Description of Unknown: Exemplary gene or splice site sequence"
aggguaaaga

SEQ ID NO: 727 - RNA, 10 nt, Unknown
  source: /note="Description of Unknown: Exemplary gene or splice site sequence"
aggguaaaua

SEQ ID NO: 728 - RNA, 10 nt, Unknown
  source: /note="Description of Unknown: Exemplary gene or splice site sequence"
aggguaaauc

SEQ ID NO: 729 - RNA, 10 nt, Unknown
  source: /note="Description of Unknown: Exemplary gene or splice site sequence"
aggguaaauu

SEQ ID NO: 730 - RNA, 10 nt, Unknown
  source: /note="Description of Unknown: Exemplary gene or splice site sequence"
aggguaacca

SEQ ID NO: 731 - RNA, 10 nt, Unknown
  source: /note="Description of Unknown: Exemplary gene or splice site sequence"
aggguaacug

SEQ ID NO: 732 - RNA, 10 nt, Unknown
  source: /note="Description of Unknown: Exemplary gene or splice site sequence"
aggguaacuu

SEQ ID NO: 733 - RNA, 10 nt, Unknown
  source: /note="Description of Unknown: Exemplary gene or splice site sequence"
aggguaagaa

SEQ ID NO: 734 - RNA, 10 nt, Unknown
  source: /note="Description of Unknown: Exemplary gene or splice site sequence"
aggguaagag

SEQ ID NO: 735 - RNA, 10 nt, Unknown
  source: /note="Description of Unknown: Exemplary gene or splice site sequence"
aggguaagau

SEQ ID NO: 736 - RNA, 10 nt, Unknown
  source: /note="Description of Unknown: Exemplary gene or splice site sequence"
aggguaagca

SEQ ID NO: 737 - RNA, 10 nt, Unknown
  source: /note="Description of Unknown: Exemplary gene or splice site sequence"
aggguaagga

SEQ ID NO: 738 - RNA, 10 nt, Unknown
  source: /note="Description of Unknown: Exemplary gene or splice site sequence"
aggguaaggc

SEQ ID NO: 739 - RNA, 10 nt, Unknown
  source: /note="Description of Unknown: Exemplary gene or splice site sequence"
aggguaaggg

SEQ ID NO: 740 - RNA, 10 nt, Unknown
  source: /note="Description of Unknown: Exemplary gene or splice site sequence"
aggguaagua

SEQ ID NO: 741 - RNA, 10 nt, Unknown
  source: /note="Description of Unknown: Exemplary gene or splice site sequence"
aggguaaguc

SEQ ID NO: 742 - RNA, 10 nt, Unknown
  source: /note="Description of Unknown: Exemplary gene or splice site sequence"
aggguaagug

SEQ ID NO: 743 - RNA, 10 nt, Unknown
  source: /note="Description of Unknown: Exemplary gene or splice site sequence"
aggguaaguu

SEQ ID NO: 744 - RNA, 10 nt, Unknown
  source: /note="Description of Unknown: Exemplary gene or splice site sequence"
aggguaauac

SEQ ID NO: 745 - RNA, 10 nt, Unknown
  source: /note="Description of Unknown: Exemplary gene or splice site sequence"
aggguaauga

SEQ ID NO: 746 - RNA, 10 nt, Unknown
  source: /note="Description of Unknown: Exemplary gene or splice site sequence"
aggguaauua

SEQ ID NO: 747 - RNA, 10 nt, Unknown
  source: /note="Description of Unknown: Exemplary gene or splice site sequence"
aggguaauuu

SEQ ID NO: 748 - RNA, 10 nt, Unknown
  source: /note="Description of Unknown: Exemplary gene or splice site sequence"
aggguacacc

SEQ ID NO: 749 - RNA, 10 nt, Unknown
  source: /note="Description of Unknown: Exemplary gene or splice site sequence"
aggguacagu

SEQ ID NO: 750 - RNA, 10 nt, Unknown
  source: /note="Description of Unknown: Exemplary gene or splice site sequence"
aggguacggu

SEQ ID NO: 751 - RNA, 10 nt, Unknown
  source: /note="Description of Unknown: Exemplary gene or splice site sequence"
aggguaggac

SEQ ID NO: 752 - RNA, 10 nt, Unknown
  source: /note="Description of Unknown: Exemplary gene or splice site sequence"
aggguaggag

SEQ ID NO: 753 - RNA, 10 nt, Unknown
  source: /note="Description of Unknown: Exemplary gene or splice site sequence"
aggguaggca

SEQ ID NO: 754 - RNA, 10 nt, Unknown
  source: /note="Description of Unknown: Exemplary gene or splice site sequence"
aggguaggcc

SEQ ID NO: 755 - RNA, 10 nt, Unknown
  source: /note="Description of Unknown: Exemplary gene or splice site sequence"
aggguaggga

SEQ ID NO: 756 - RNA, 10 nt, Unknown
  source: /note="Description of Unknown: Exemplary gene or splice site sequence"
aggguagggu

SEQ ID NO: 757 - RNA, 10 nt, Unknown
  source: /note="Description of Unknown: Exemplary gene or splice site sequence"
aggguagguc

SEQ ID NO: 758 - RNA, 10 nt, Unknown
  source: /note="Description of Unknown: Exemplary gene or splice site sequence"
aggguaggug

SEQ ID NO: 759 - RNA, 10 nt, Unknown
  source: /note="Description of Unknown: Exemplary gene or splice site sequence"
aggguagguu

SEQ ID NO: 760 - RNA, 10 nt, Unknown
  source: /note="Description of Unknown: Exemplary gene or splice site sequence"
aggguauaua

SEQ ID NO: 761 - RNA, 10 nt, Unknown
  source: /note="Description of Unknown: Exemplary gene or splice site sequence"
aggguaugac

SEQ ID NO: 762 - RNA, 10 nt, Unknown
  source: /note="Description of Unknown: Exemplary gene or splice site sequence"
aggguaugag

SEQ ID NO: 763 - RNA, 10 nt, Unknown
  source: /note="Description of Unknown: Exemplary gene or splice site sequence"
aggguaugau

SEQ ID NO: 764 - RNA, 10 nt, Unknown
  source: /note="Description of Unknown: Exemplary gene or splice site sequence"
aggguaugca

SEQ ID NO: 765 - RNA, 10 nt, Unknown
  source: /note="Description of Unknown: Exemplary gene or splice site sequence"
aggguaugcu

SEQ ID NO: 766 - RNA, 10 nt, Unknown
  source: /note="Description of Unknown: Exemplary gene or splice site sequence"
aggguauggg

SEQ ID NO: 767 - RNA, 10 nt, Unknown
  source: /note="Description of Unknown: Exemplary gene or splice site sequence"
aggguauggu

SEQ ID NO: 768 - RNA, 10 nt, Unknown
  source: /note="Description of Unknown: Exemplary gene or splice site sequence"
aggguaugua

SEQ ID NO: 769 - RNA, 10 nt, Unknown
  source: /note="Description of Unknown: Exemplary gene or splice site sequence"
aggguauguc

SEQ ID NO: 770 - RNA, 10 nt, Unknown
  source: /note="Description of Unknown: Exemplary gene or splice site sequence"
aggguaugug

SEQ ID NO: 771 - RNA, 10 nt, Unknown
  source: /note="Description of Unknown: Exemplary gene or splice site sequence"
aggguauuac

SEQ ID NO: 772 - RNA, 10 nt, Unknown
  source: /note="Description of Unknown: Exemplary gene or splice site sequence"
aggguauucu

SEQ ID NO: 773 - RNA, 10 nt, Unknown
  source: /note="Description of Unknown: Exemplary gene or splice site sequence"
aggguauuuc

SEQ ID NO: 774 - RNA, 10 nt, Unknown
  source: /note="Description of Unknown: Exemplary gene or splice site sequence"
agggucagag

SEQ ID NO: 775 - RNA, 10 nt, Unknown
  source: /note="Description of Unknown: Exemplary gene or splice site sequence"
agggucagca

SEQ ID NO: 776 - RNA, 10 nt, Unknown
  source: /note="Description of Unknown: Exemplary gene or splice site sequence"
agggucagga

SEQ ID NO: 777 - RNA, 10 nt, Unknown
  source: /note="Description of Unknown: Exemplary gene or splice site sequence"
agggucaggg

SEQ ID NO: 778 - RNA, 10 nt, Unknown
  source: /note="Description of Unknown: Exemplary gene or splice site sequence"
agggucagug

SEQ ID NO: 779 - RNA, 10 nt, Unknown
  source: /note="Description of Unknown: Exemplary gene or splice site sequence"
agggucaguu

SEQ ID NO: 780 - RNA, 10 nt, Unknown
  source: /note="Description of Unknown: Exemplary gene or splice site sequence"
aggguccccu

SEQ ID NO: 781 - RNA, 10 nt, Unknown
  source: /note="Description of Unknown: Exemplary gene or splice site sequence"
agggucggga

SEQ ID NO: 782 - RNA, 10 nt, Unknown
  source: /note="Description of Unknown: Exemplary gene or splice site sequence"
agggucugca

SEQ ID NO: 783 - RNA, 10 nt, Unknown
  source: /note="Description of Unknown: Exemplary gene or splice site sequence"
agggucuguu

SEQ ID NO: 784 - RNA, 10 nt, Unknown
  source: /note="Description of Unknown: Exemplary gene or splice site sequence"
agggugaaga

SEQ ID NO: 785 - RNA, 10 nt, Unknown
  source: /note="Description of Unknown: Exemplary gene or splice site sequence"
agggugacua

SEQ ID NO: 786 - RNA, 10 nt, Unknown
  source: /note="Description of Unknown: Exemplary gene or splice site sequence"
agggugagaa

SEQ ID NO: 787 - RNA, 10 nt, Unknown
  source: /note="Description of Unknown: Exemplary gene or splice site sequence"
agggugagac

SEQ ID NO: 788 - RNA, 10 nt, Unknown
  source: /note="Description of Unknown: Exemplary gene or splice site sequence"
agggugagag

SEQ ID NO: 789 - RNA, 10 nt, Unknown
  source: /note="Description of Unknown: Exemplary gene or splice site sequence"
agggugagca

SEQ ID NO: 790 - RNA, 10 nt, Unknown
  source: /note="Description of Unknown: Exemplary gene or splice site sequence"
agggugagcc

SEQ ID NO: 791 - RNA, 10 nt, Unknown
  source: /note="Description of Unknown: Exemplary gene or splice site sequence"
agggugagcu

SEQ ID NO: 792 - RNA, 10 nt, Unknown
  source: /note="Description of Unknown: Exemplary gene or splice site sequence"
agggugagga

SEQ ID NO: 793 - RNA, 10 nt, Unknown
  source: /note="Description of Unknown: Exemplary gene or splice site sequence"
agggugaggg

SEQ ID NO: 794 - RNA, 10 nt, Unknown
  source: /note="Description of Unknown: Exemplary gene or splice site sequence"
agggugaggu

SEQ ID NO: 795 - RNA, 10 nt, Unknown
  source: /note="Description of Unknown: Exemplary gene or splice site sequence"
agggugagua

SEQ ID NO: 796 - RNA, 10 nt, Unknown
  source: /note="Description of Unknown: Exemplary gene or splice site sequence"
agggugaguc

SEQ ID NO: 797 - RNA, 10 nt, Unknown
  source: /note="Description of Unknown: Exemplary gene or splice site sequence"
agggugagug

SEQ ID NO: 798 - RNA, 10 nt, Unknown
  source: /note="Description of Unknown: Exemplary gene or splice site sequence"
agggugaguu

SEQ ID NO: 799 - RNA, 10 nt, Unknown
  source: /note="Description of Unknown: Exemplary gene or splice site sequence"
agggugggga

SEQ ID NO: 800 - RNA, 10 nt, Unknown
  source: /note="Description of Unknown: Exemplary gene or splice site sequence"
aggguggggu

SEQ ID NO: 801 - RNA, 10 nt, Unknown
  source: /note="Description of Unknown: Exemplary gene or splice site sequence"
agggugggua

SEQ ID NO: 802 - RNA, 10 nt, Unknown
  source: /note="Description of Unknown: Exemplary gene or splice site sequence"
agggugggug

SEQ ID NO: 803 - RNA, 10 nt, Unknown
  source: /note="Description of Unknown: Exemplary gene or splice site sequence"
agggugugua

SEQ ID NO: 804 - RNA, 10 nt, Unknown
  source: /note="Description of Unknown: Exemplary gene or splice site sequence"
agggugugug

SEQ ID NO: 805 - RNA, 10 nt, Unknown
  source: /note="Description of Unknown: Exemplary gene or splice site sequence"
aggguuaaug

SEQ ID NO: 806 - RNA, 10 nt, Unknown
  source: /note="Description of Unknown: Exemplary gene or splice site sequence"
aggguuagaa

SEQ ID NO: 807 - RNA, 10 nt, Unknown
  source: /note="Description of Unknown: Exemplary gene or splice site sequence"
aggguuaguu

SEQ ID NO: 808 - RNA, 10 nt, Unknown
  source: /note="Description of Unknown: Exemplary gene or splice site sequence"
aggguuggug

SEQ ID NO: 809 - RNA, 10 nt, Unknown
  source: /note="Description of Unknown: Exemplary gene or splice site sequence"
aggguuugug

SEQ ID NO: 810 - RNA, 10 nt, Unknown
  source: /note="Description of Unknown: Exemplary gene or splice site sequence"
aggguuuguu

SEQ ID NO: 811 - RNA, 10 nt, Unknown
  source: /note="Description of Unknown: Exemplary gene or splice site sequence"
aguguaaaag

SEQ ID NO: 812 - RNA, 10 nt, Unknown
  source: /note="Description of Unknown: Exemplary gene or splice site sequence"
aguguaaaua

SEQ ID NO: 813 - RNA, 10 nt, Unknown
  source: /note="Description of Unknown: Exemplary gene or splice site sequence"
aguguaaauu

SEQ ID NO: 814 - RNA, 10 nt, Unknown
  source: /note="Description of Unknown: Exemplary gene or splice site sequence"
aguguaagaa

SEQ ID NO: 815 - RNA, 10 nt, Unknown
  source: /note="Description of Unknown: Exemplary gene or splice site sequence"
aguguaagag

SEQ ID NO: 816 - RNA, 10 nt, Unknown
  source: /note="Description of Unknown: Exemplary gene or splice site sequence"
aguguaagau

SEQ ID NO: 817 - RNA, 10 nt, Unknown
  source: /note="Description of Unknown: Exemplary gene or splice site sequence"
aguguaagca

SEQ ID NO: 818 - RNA, 10 nt, Unknown
  source: /note="Description of Unknown: Exemplary gene or splice site sequence"
aguguaagcc

SEQ ID NO: 819 - RNA, 10 nt, Unknown
  source: /note="Description of Unknown: Exemplary gene or splice site sequence"
aguguaagua

SEQ ID NO: 820 - RNA, 10 nt, Unknown
  source: /note="Description of Unknown: Exemplary gene or splice site sequence"
aguguaagug

SEQ ID NO: 821 - RNA, 10 nt, Unknown
  source: /note="Description of Unknown: Exemplary gene or splice site sequence"
aguguaaguu

SEQ ID NO: 822 - RNA, 10 nt, Unknown
  source: /note="Description of Unknown: Exemplary gene or splice site sequence"
aguguaauug

SEQ ID NO: 823 - RNA, 10 nt, Unknown
  source: /note="Description of Unknown: Exemplary gene or splice site sequence"
aguguaggac

SEQ ID NO: 824 - RNA, 10 nt, Unknown
  source: /note="Description of Unknown: Exemplary gene or splice site sequence"
aguguagguc

SEQ ID NO: 825 - RNA, 10 nt, Unknown
  source: /note="Description of Unknown: Exemplary gene or splice site sequence"
aguguaugag

SEQ ID NO: 826 - RNA, 10 nt, Unknown
  source: /note="Description of Unknown: Exemplary gene or splice site sequence"
aguguaugua

SEQ ID NO: 827 - RNA, 10 nt, Unknown
  source: /note="Description of Unknown: Exemplary gene or splice site sequence"
aguguauguu

SEQ ID NO: 828 - RNA, 10 nt, Unknown
  source: /note="Description of Unknown: Exemplary gene or splice site sequence"
aguguauugu

SEQ ID NO: 829 - RNA, 10 nt, Unknown
  source: /note="Description of Unknown: Exemplary gene or splice site sequence"
aguguauuua

SEQ ID NO: 830 - RNA, 10 nt, Unknown
  source: /note="Description of Unknown: Exemplary gene or splice site sequence"
agugucaguc

SEQ ID NO: 831 - RNA, 10 nt, Unknown
  source: /note="Description of Unknown: Exemplary gene or splice site sequence"
agugugagag

SEQ ID NO: 832 - RNA, 10 nt, Unknown
  source: /note="Description of Unknown: Exemplary gene or splice site sequence"
agugugagca

SEQ ID NO: 833 - RNA, 10 nt, Unknown
  source: /note="Description of Unknown: Exemplary gene or splice site sequence"
agugugagcc

SEQ ID NO: 834 - RNA, 10 nt, Unknown
  source: /note="Description of Unknown: Exemplary gene or splice site sequence"
agugugagcu

SEQ ID NO: 835 - RNA, 10 nt, Unknown
  source: /note="Description of Unknown: Exemplary gene or splice site sequence"
agugugagua

SEQ ID NO: 836 - RNA, 10 nt, Unknown
  source: /note="Description of Unknown: Exemplary gene or splice site sequence"
agugugaguc

SEQ ID NO: 837 - RNA, 10 nt, Unknown
  source: /note="Description of Unknown: Exemplary gene or splice site sequence"
agugugagug

SEQ ID NO: 838 - RNA, 10 nt, Unknown
  source: /note="Description of Unknown: Exemplary gene or splice site sequence"
agugugaguu

SEQ ID NO: 839 - RNA, 10 nt, Unknown
  source: /note="Description of Unknown: Exemplary gene or splice site sequence"
agugugggua

SEQ ID NO: 840 - RNA, 10 nt, Unknown
  source: /note="Description of Unknown: Exemplary gene or splice site sequence"
agugugggug

SEQ ID NO: 841 - RNA, 10 nt, Unknown
  source: /note="Description of Unknown: Exemplary gene or splice site sequence"
agugugugua

SEQ ID NO: 842 - RNA, 10 nt, Unknown
  source: /note="Description of Unknown: Exemplary gene or splice site sequence"
aguguuccua

SEQ ID NO: 843 - RNA, 10 nt, Unknown
  source: /note="Description of Unknown: Exemplary gene or splice site sequence"
aguguugggg

SEQ ID NO: 844 - RNA, 10 nt, Unknown
  source: /note="Description of Unknown: Exemplary gene or splice site sequence"
aguguuucag

SEQ ID NO: 845 - RNA, 10 nt, Unknown
  source: /note="Description of Unknown: Exemplary gene or splice site sequence"
auaguaaaua

SEQ ID NO: 846 - RNA, 10 nt, Unknown
  source: /note="Description of Unknown: Exemplary gene or splice site sequence"
auaguaagac

SEQ ID NO: 847 - RNA, 10 nt, Unknown
  source: /note="Description of Unknown: Exemplary gene or splice site sequence"
auaguaagau

SEQ ID NO: 848 - RNA, 10 nt, Unknown
  source: /note="Description of Unknown: Exemplary gene or splice site sequence"
auaguaagca

SEQ ID NO: 849 - RNA, 10 nt, Unknown
  source: /note="Description of Unknown: Exemplary gene or splice site sequence"
auaguaagua

SEQ ID NO: 850 - RNA, 10 nt, Unknown
  source: /note="Description of Unknown: Exemplary gene or splice site sequence"
auaguaagug

SEQ ID NO: 851 - RNA, 10 nt, Unknown
  source: /note="Description of Unknown: Exemplary gene or splice site sequence"
auaguaaguu

SEQ ID NO: 852 - RNA, 10 nt, Unknown
  source: /note="Description of Unknown: Exemplary gene or splice site sequence"
auaguaggua

SEQ ID NO: 853 - RNA, 10 nt, Unknown
  source: /note="Description of Unknown: Exemplary gene or splice site sequence"
auaguauguu

SEQ ID NO: 854 - RNA, 10 nt, Unknown
  source: /note="Description of Unknown: Exemplary gene or splice site sequence"
auagucucac

SEQ ID NO: 855 - RNA, 10 nt, Unknown
  source: /note="Description of Unknown: Exemplary gene or splice site sequence"
auagugagac

SEQ ID NO: 856 - RNA, 10 nt, Unknown
  source: /note="Description of Unknown: Exemplary gene or splice site sequence"
auagugagag

SEQ ID NO: 857 - RNA, 10 nt, Unknown
  source: /note="Description of Unknown: Exemplary gene or splice site sequence"
auagugagau

SEQ ID NO: 858 - RNA, 10 nt, Unknown
  source: /note="Description of Unknown: Exemplary gene or splice site sequence"
auagugagcc

SEQ ID NO: 859 - RNA, 10 nt, Unknown
  source: /note="Description of Unknown: Exemplary gene or splice site sequence"
auagugaggc

SEQ ID NO: 860 - RNA, 10 nt, Unknown
  source: /note="Description of Unknown: Exemplary gene or splice site sequence"
auagugagua

SEQ ID NO: 861 - RNA, 10 nt, Unknown
  source: /note="Description of Unknown: Exemplary gene or splice site sequence"
auagugaguc

SEQ ID NO: 862 - RNA, 10 nt, Unknown
  source: /note="Description of Unknown: Exemplary gene or splice site sequence"
auagugagug

SEQ ID NO: 863 - RNA, 10 nt, Unknown
  source: /note="Description of Unknown: Exemplary gene or splice site sequence"
auagugcguc

SEQ ID NO: 864 - RNA, 10 nt, Unknown
  source: /note="Description of Unknown: Exemplary gene or splice site sequence"
auagugugua

SEQ ID NO: 865 - RNA, 10 nt, Unknown
  source: /note="Description of Unknown: Exemplary gene or splice site sequence"
auaguucagu

SEQ ID NO: 866 - RNA, 10 nt, Unknown
  source: /note="Description of Unknown: Exemplary gene or splice site sequence"
aucguaagcc

SEQ ID NO: 867 - RNA, 10 nt, Unknown
  source: /note="Description of Unknown: Exemplary gene or splice site sequence"
aucguaaguu

SEQ ID NO: 868 - RNA, 10 nt, Unknown
  source: /note="Description of Unknown: Exemplary gene or splice site sequence"
aucguauucc

SEQ ID NO: 869 - RNA, 10 nt, Unknown
  source: /note="Description of Unknown: Exemplary gene or splice site sequence"
aucgugagua

SEQ ID NO: 870 - RNA, 10 nt, Unknown
  source: /note="Description of Unknown: Exemplary gene or splice site sequence"
auggcaagcg

SEQ ID NO: 871 - RNA, 10 nt, Unknown
  source: /note="Description of Unknown: Exemplary gene or splice site sequence"
auggcaagga

SEQ ID NO: 872 - RNA, 10 nt, Unknown
  source: /note="Description of Unknown: Exemplary gene or splice site sequence"
auggcaaguu

SEQ ID NO: 873 - RNA, 10 nt, Unknown
  source: /note="Description of Unknown: Exemplary gene or splice site sequence"
auggcaggua

SEQ ID NO: 874 - RNA, 10 nt, Unknown
  source: /note="Description of Unknown: Exemplary gene or splice site sequence"
auggcaugug

SEQ ID NO: 875 - RNA, 10 nt, Unknown
  source: /note="Description of Unknown: Exemplary gene or splice site sequence"
auggcgccau

SEQ ID NO: 876 - RNA, 10 nt, Unknown
  source: /note="Description of Unknown: Exemplary gene or splice site sequence"
auggcuugug

SEQ ID NO: 877 - RNA, 10 nt, Unknown
  source: /note="Description of Unknown: Exemplary gene or splice site sequence"
augguaaaac

SEQ ID NO: 878 - RNA, 10 nt, Unknown
  source: /note="Description of Unknown: Exemplary gene or splice site sequence"
augguaaaau

SEQ ID NO: 879 - RNA, 10 nt, Unknown
  source: /note="Description of Unknown: Exemplary gene or splice site sequence"
augguaaacc

SEQ ID NO: 880 - RNA, 10 nt, Unknown
  source: /note="Description of Unknown: Exemplary gene or splice site sequence"
augguaaaga

SEQ ID NO: 881 - RNA, 10 nt, Unknown
  source: /note="Description of Unknown: Exemplary gene or splice site sequence"
augguaaaua

SEQ ID NO: 882 - RNA, 10 nt, Unknown
  source: /note="Description of Unknown: Exemplary gene or splice site sequence"
augguaaaug

SEQ ID NO: 883 - RNA, 10 nt, Unknown
  source: /note="Description of Unknown: Exemplary gene or splice site sequence"
augguaaauu

SEQ ID NO: 884 - RNA, 10 nt, Unknown
  source: /note="Description of Unknown: Exemplary gene or splice site sequence"
augguaacag

SEQ ID NO: 885 - RNA, 10 nt, Unknown
  source: /note="Description of Unknown: Exemplary gene or splice site sequence"
augguaacau

SEQ ID NO: 886 - RNA, 10 nt, Unknown
  source: /note="Description of Unknown: Exemplary gene or splice site sequence"
augguaacua

SEQ ID NO: 887 - RNA, 10 nt, Unknown
  source: /note="Description of Unknown: Exemplary gene or splice site sequence"
augguaacuc

SEQ ID NO: 888 - RNA, 10 nt, Unknown
  source: /note="Description of Unknown: Exemplary gene or splice site sequence"
augguaacuu

SEQ ID NO: 889 - RNA, 10 nt, Unknown
  source: /note="Description of Unknown: Exemplary gene or splice site sequence"
augguaagaa

SEQ ID NO: 890 - RNA, 10 nt, Unknown
  source: /note="Description of Unknown: Exemplary gene or splice site sequence"
augguaagac

SEQ ID NO: 891 - RNA, 10 nt, Unknown
  source: /note="Description of Unknown: Exemplary gene or splice site sequence"
augguaagag

SEQ ID NO: 892 - RNA, 10 nt, Unknown
  source: /note="Description of Unknown: Exemplary gene or splice site sequence"
augguaagau

SEQ ID NO: 893 - RNA, 10 nt, Unknown
  source: /note="Description of Unknown: Exemplary gene or splice site sequence"
augguaagca

SEQ ID NO: 894 - RNA, 10 nt, Unknown
  source: /note="Description of Unknown: Exemplary gene or splice site sequence"
augguaagcc

SEQ ID NO: 895 - RNA, 10 nt, Unknown
  source: /note="Description of Unknown: Exemplary gene or splice site sequence"
augguaagcu

SEQ ID NO: 896 - RNA, 10 nt, Unknown
  source: /note="Description of Unknown: Exemplary gene or splice site sequence"
augguaagga

SEQ ID NO: 897 - RNA, 10 nt, Unknown
  source: /note="Description of Unknown: Exemplary gene or splice site sequence"
augguaaggg

SEQ ID NO: 898 - RNA, 10 nt, Unknown
  source: /note="Description of Unknown: Exemplary gene or splice site sequence"
augguaagua

SEQ ID NO: 899 - RNA, 10 nt, Unknown
  source: /note="Description of Unknown: Exemplary gene or splice site sequence"
augguaaguc

SEQ ID NO: 900 - RNA, 10 nt, Unknown
  source: /note="Description of Unknown: Exemplary gene or splice site sequence"
augguaagug

SEQ ID NO: 901 - RNA, 10 nt, Unknown
  source: /note="Description of Unknown: Exemplary gene or splice site sequence"
augguaaguu

SEQ ID NO: 902 - RNA, 10 nt, Unknown
  source: /note="Description of Unknown: Exemplary gene or splice site sequence"
augguaauaa

SEQ ID NO: 903 - RNA, 10 nt, Unknown
  source: /note="Description of Unknown: Exemplary gene or splice site sequence"
augguaauau

SEQ ID NO: 904 - RNA, 10 nt, Unknown
  source: /note="Description of Unknown: Exemplary gene or splice site sequence"
augguaauga

SEQ ID NO: 905 - RNA, 10 nt, Unknown
  source: /note="Description of Unknown: Exemplary gene or splice site sequence"
augguaaugg

SEQ ID NO: 906 - RNA, 10 nt, Unknown
  source: /note="Description of Unknown: Exemplary gene or splice site sequence"
augguaauug

SEQ ID NO: 907 - RNA, 10 nt, Unknown
  source: /note="Description of Unknown: Exemplary gene or splice site sequence"
augguaauuu

SEQ ID NO: 908 - RNA, 10 nt, Unknown
  source: /note="Description of Unknown: Exemplary gene or splice site sequence"
augguacagc

SEQ ID NO: 909 - RNA, 10 nt, Unknown
  source: /note="Description of Unknown: Exemplary gene or splice site sequence"
augguacauc

SEQ ID NO: 910 - RNA, 10 nt, Unknown
  source: /note="Description of Unknown: Exemplary gene or splice site sequence"
augguaccag

SEQ ID NO: 911 - RNA, 10 nt, Unknown
  source: /note="Description of Unknown: Exemplary gene or splice site sequence"
augguaccug

SEQ ID NO: 912 - RNA, 10 nt, Unknown
  source: /note="Description of Unknown: Exemplary gene or splice site sequence"
augguacgag

SEQ ID NO: 913 - RNA, 10 nt, Unknown
  source: /note="Description of Unknown: Exemplary gene or splice site sequence"
augguacggu

SEQ ID NO: 914 - RNA, 10 nt, Unknown
  source: /note="Description of Unknown: Exemplary gene or splice site sequence"
augguagauc

SEQ ID NO: 915 - RNA, 10 nt, Unknown
  source: /note="Description of Unknown: Exemplary gene or splice site sequence"
augguagcag

SEQ ID NO: 916 - RNA, 10 nt, Unknown
  source: /note="Description of Unknown: Exemplary gene or splice site sequence"
augguagcug

SEQ ID NO: 917 - RNA, 10 nt, Unknown
  source: /note="Description of Unknown: Exemplary gene or splice site sequence"
augguaggaa

SEQ ID NO: 918 - RNA, 10 nt, Unknown
  source: /note="Description of Unknown: Exemplary gene or splice site sequence"
augguaggau

SEQ ID NO: 919 - RNA, 10 nt, Unknown
  source: /note="Description of Unknown: Exemplary gene or splice site sequence"
augguaggca

SEQ ID NO: 920 - RNA, 10 nt, Unknown
  source: /note="Description of Unknown: Exemplary gene or splice site sequence"
augguaggcu

SEQ ID NO: 921 - RNA, 10 nt, Unknown
  source: /note="Description of Unknown: Exemplary gene or splice site sequence"
augguagggg

SEQ ID NO: 922 - RNA, 10 nt, Unknown
  source: /note="Description of Unknown: Exemplary gene or splice site sequence"
augguagggu

SEQ ID NO: 923 - RNA, 10 nt, Unknown
  source: /note="Description of Unknown: Exemplary gene or splice site sequence"
augguaggua

SEQ ID NO: 924 - RNA, 10 nt, Unknown
  source: /note="Description of Unknown: Exemplary gene or splice site sequence"
augguaggug

SEQ ID NO: 925 - RNA, 10 nt, Unknown
  source: /note="Description of Unknown: Exemplary gene or splice site sequence"
augguaguuu

SEQ ID NO: 926 - RNA, 10 nt, Unknown
  source: /note="Description of Unknown: Exemplary gene or splice site sequence"
augguauagu

SEQ ID NO: 927 - RNA, 10 nt, Unknown
  source: /note="Description of Unknown: Exemplary gene or splice site sequence"
augguauaua

SEQ ID NO: 928 - RNA, 10 nt, Unknown
  source: /note="Description of Unknown: Exemplary gene or splice site sequence"
augguaucag

SEQ ID NO: 929 - RNA, 10 nt, Unknown
  source: /note="Description of Unknown: Exemplary gene or splice site sequence"
augguaucuu

SEQ ID NO: 930 - RNA, 10 nt, Unknown
  source: /note="Description of Unknown: Exemplary gene or splice site sequence"
augguaugau

SEQ ID NO: 931 - RNA, 10 nt, Unknown
  source: /note="Description of Unknown: Exemplary gene or splice site sequence"
augguaugca

SEQ ID NO: 932 - RNA, 10 nt, Unknown
  source: /note="Description of Unknown: Exemplary gene or splice site sequence"
augguaugcc

SEQ ID NO: 933 - RNA, 10 nt, Unknown
  source: /note="Description of Unknown: Exemplary gene or splice site sequence"
augguaugcg

SEQ ID NO: 934 - RNA, 10 nt, Unknown
  source: /note="Description of Unknown: Exemplary gene or splice site sequence"
augguaugcu

SEQ ID NO: 935 - RNA, 10 nt, Unknown
  source: /note="Description of Unknown: Exemplary gene or splice site sequence"
augguaugga

SEQ ID NO: 936 - RNA, 10 nt, Unknown
  source: /note="Description of Unknown: Exemplary gene or splice site sequence"
augguauggc

SEQ ID NO: 937 - RNA, 10 nt, Unknown
  source: /note="Description of Unknown: Exemplary gene or splice site sequence"
augguaugug

SEQ ID NO: 938 - RNA, 10 nt, Unknown
  source: /note="Description of Unknown: Exemplary gene or splice site sequence"
augguauguu

SEQ ID NO: 939 - RNA, 10 nt, Unknown
  source: /note="Description of Unknown: Exemplary gene or splice site sequence"
augguauuau

SEQ ID NO: 940 - RNA, 10 nt, Unknown
  source: /note="Description of Unknown: Exemplary gene or splice site sequence"
augguauuga

SEQ ID NO: 941 - RNA, 10 nt, Unknown
  source: /note="Description of Unknown: Exemplary gene or splice site sequence"
augguauuug

SEQ ID NO: 942 - RNA, 10 nt, Unknown
  source: /note="Description of Unknown: Exemplary gene or splice site sequence"
auggucaggg

SEQ ID NO: 943 - RNA, 10 nt, Unknown
  source: /note="Description of Unknown: Exemplary gene or splice site sequence"
auggucaguc

SEQ ID NO: 944 - RNA, 10 nt, Unknown
  source: /note="Description of Unknown: Exemplary gene or splice site sequence"
auggucagug

SEQ ID NO: 945 - RNA, 10 nt, Unknown
  source: /note="Description of Unknown: Exemplary gene or splice site sequence"
auggucauuu

SEQ ID NO: 946 - RNA, 10 nt, Unknown
  source: /note="Description of Unknown: Exemplary gene or splice site sequence"
auggugaaaa

SEQ ID NO: 947 - RNA, 10 nt, Unknown
  source: /note="Description of Unknown: Exemplary gene or splice site sequence"
auggugaaac

SEQ ID NO: 948 - RNA, 10 nt, Unknown
  source: /note="Description of Unknown: Exemplary gene or splice site sequence"
auggugaaau

SEQ ID NO: 949 - RNA, 10 nt, Unknown
  source: /note="Description of Unknown: Exemplary gene or splice site sequence"
auggugaacu

SEQ ID NO: 950 - RNA, 10 nt, Unknown
  source: /note="Description of Unknown: Exemplary gene or splice site sequence"
auggugaaga

SEQ ID NO: 951 - RNA, 10 nt, Unknown
  source: /note="Description of Unknown: Exemplary gene or splice site sequence"
auggugacgu

SEQ ID NO: 952 - RNA, 10 nt, Unknown
  source: /note="Description of Unknown: Exemplary gene or splice site sequence"
auggugagaa

SEQ ID NO: 953 - RNA, 10 nt, Unknown
  source: /note="Description of Unknown: Exemplary gene or splice site sequence"
auggugagac

SEQ ID NO: 954 - RNA, 10 nt, Unknown
  source: /note="Description of Unknown: Exemplary gene or splice site sequence"
auggugagag

SEQ ID NO: 955 - RNA, 10 nt, Unknown
  source: /note="Description of Unknown: Exemplary gene or splice site sequence"
auggugagca

SEQ ID NO: 956 - RNA, 10 nt, Unknown
  source: /note="Description of Unknown: Exemplary gene or splice site sequence"
auggugagcc

SEQ ID NO: 957 - RNA, 10 nt, Unknown
  source: /note="Description of Unknown: Exemplary gene or splice site sequence"
auggugagcg

SEQ ID NO: 958 - RNA, 10 nt, Unknown
  source: /note="Description of Unknown: Exemplary gene or splice site sequence"
auggugagcu

SEQ ID NO: 959 - RNA, 10 nt, Unknown
  source: /note="Description of Unknown: Exemplary gene or splice site sequence"
auggugaggc

SEQ ID NO: 960 - RNA, 10 nt, Unknown
  source: /note="Description of Unknown: Exemplary gene or splice site sequence"
auggugaggg

SEQ ID NO: 961 - RNA, 10 nt, Unknown
  source: /note="Description of Unknown: Exemplary gene or splice site sequence"
auggugagua

SEQ ID NO: 962 - RNA, 10 nt, Unknown
  source: /note="Description of Unknown: Exemplary gene or splice site sequence"
auggugaguc

SEQ ID NO: 963 - RNA, 10 nt, Unknown
  source: /note="Description of Unknown: Exemplary gene or splice site sequence"
auggugagug

SEQ ID NO: 964 - RNA, 10 nt, Unknown
  source: /note="Description of Unknown: Exemplary gene or splice site sequence"
auggugaguu

SEQ ID NO: 965 - RNA, 10 nt, Unknown
  source: /note="Description of Unknown: Exemplary gene or splice site sequence"
auggugauuu

SEQ ID NO: 966 - RNA, 10 nt, Unknown
  source: /note="Description of Unknown: Exemplary gene or splice site sequence"
auggugcgau

SEQ ID NO: 967 - RNA, 10 nt, Unknown
  source: /note="Description of Unknown: Exemplary gene or splice site sequence"
auggugcgug

SEQ ID NO: 968 - RNA, 10 nt, Unknown
  source: /note="Description of Unknown: Exemplary gene or splice site sequence"
auggugggua

SEQ ID NO: 969 - RNA, 10 nt, Unknown
  source: /note="Description of Unknown: Exemplary gene or splice site sequence"
auggugggug

SEQ ID NO: 970 - RNA, 10 nt, Unknown
  source: /note="Description of Unknown: Exemplary gene or splice site sequence"
augguggguu

SEQ ID NO: 971 - RNA, 10 nt, Unknown
  source: /note="Description of Unknown: Exemplary gene or splice site sequence"
auggugguua

SEQ ID NO: 972 - RNA, 10 nt, Unknown
  source: /note="Description of Unknown: Exemplary gene or splice site sequence"
augguguaag

SEQ ID NO: 973 - RNA, 10 nt, Unknown
  source: /note="Description of Unknown: Exemplary gene or splice site sequence"
auggugugaa

SEQ ID NO: 974 - RNA, 10 nt, Unknown
  source: /note="Description of Unknown: Exemplary gene or splice site sequence"
auggugugua

SEQ ID NO: 975 - RNA, 10 nt, Unknown
  source: /note="Description of Unknown: Exemplary gene or splice site sequence"
auggugugug

SEQ ID NO: 976 - RNA, 10 nt, Unknown
  source: /note="Description of Unknown: Exemplary gene or splice site sequence"
augguuacuc

SEQ ID NO: 977 - RNA, 10 nt, Unknown
  source: /note="Description of Unknown: Exemplary gene or splice site sequence"
augguuagca

SEQ ID NO: 978 - RNA, 10 nt, Unknown
  source: /note="Description of Unknown: Exemplary gene or splice site sequence"
augguuaguc

SEQ ID NO: 979 - RNA, 10 nt, Unknown
  source: /note="Description of Unknown: Exemplary gene or splice site sequence"
augguuagug

SEQ ID NO: 980 - RNA, 10 nt, Unknown
  source: /note="Description of Unknown: Exemplary gene or splice site sequence"
augguuaguu

SEQ ID NO: 981 - RNA, 10 nt, Unknown
  source: /note="Description of Unknown: Exemplary gene or splice site sequence"
augguucagu

SEQ ID NO: 982 - RNA, 10 nt, Unknown
  source: /note="Description of Unknown: Exemplary gene or splice site sequence"
augguucguc

SEQ ID NO: 983 - RNA, 10 nt, Unknown
  source: /note="Description of Unknown: Exemplary gene or splice site sequence"
augguuggua

SEQ ID NO: 984 - RNA, 10 nt, Unknown
  source: /note="Description of Unknown: Exemplary gene or splice site sequence"
augguugguc

SEQ ID NO: 985 - RNA, 10 nt, Unknown
  source: /note="Description of Unknown: Exemplary gene or splice site sequence"
augguugguu

SEQ ID NO: 986 - RNA, 10 nt, Unknown
  source: /note="Description of Unknown: Exemplary gene or splice site sequence"
augguuguuu

SEQ ID NO: 987 - RNA, 10 nt, Unknown
  source: /note="Description of Unknown: Exemplary gene or splice site sequence"
augguuugca

SEQ ID NO: 988 - RNA, 10 nt, Unknown
  source: /note="Description of Unknown: Exemplary gene or splice site sequence"
augguuugua

SEQ ID NO: 989 - RNA, 10 nt, Unknown
  source: /note="Description of Unknown: Exemplary gene or splice site sequence"
auugcaagua

SEQ ID NO: 990 - RNA, 10 nt, Unknown
  source: /note="Description of Unknown: Exemplary gene or splice site sequence"
auuguaaaua

SEQ ID NO: 991 - RNA, 10 nt, Unknown
  source: /note="Description of Unknown: Exemplary gene or splice site sequence"
auuguaagau

SEQ ID NO: 992 - RNA, 10 nt, Unknown
  source: /note="Description of Unknown: Exemplary gene or splice site sequence"
auuguaagca

SEQ ID NO: 993 - RNA, 10 nt, Unknown
  source: /note="Description of Unknown: Exemplary gene or splice site sequence"
auuguaagga

SEQ ID NO: 994 - RNA, 10 nt, Unknown
  source: /note="Description of Unknown: Exemplary gene or splice site sequence"
auuguaaggc

SEQ ID NO: 995 - RNA, 10 nt, Unknown
  source: /note="Description of Unknown: Exemplary gene or splice site sequence"
auuguaagua

SEQ ID NO: 996 - RNA, 10 nt, Unknown
  source: /note="Description of Unknown: Exemplary gene or splice site sequence"
auuguaaguc

SEQ ID NO: 997 - RNA, 10 nt, Unknown
  source: /note="Description of Unknown: Exemplary gene or splice site sequence"
auuguaaguu

SEQ ID NO: 998 - RNA, 10 nt, Unknown
  source: /note="Description of Unknown: Exemplary gene or splice site sequence"
auuguaauua

SEQ ID NO: 999 - RNA, 10 nt, Unknown
  source: /note="Description of Unknown: Exemplary gene or splice site sequence"
auuguaauuu

SEQ ID NO: 1000 - RNA, 10 nt, Unknown
  source: /note="Description of Unknown: Exemplary gene or splice site sequence"
auuguacaaa

SEQ ID NO: 1001 - RNA, 10 nt, Unknown
  source: /note="Description of Unknown: Exemplary gene or splice site sequence"
auuguaccuc

SEQ ID NO: 1002 - RNA, 10 nt, Unknown
  source: /note="Description of Unknown: Exemplary gene or splice site sequence"
auuguacgug

SEQ ID NO: 1003 - RNA, 10 nt, Unknown
  source: /note="Description of Unknown: Exemplary gene or splice site sequence"
auuguacuug

SEQ ID NO: 1004 - RNA, 10 nt, Unknown
  source: /note="Description of Unknown: Exemplary gene or splice site sequence"
auuguaggua

SEQ ID NO: 1005 - RNA, 10 nt, Unknown
  source: /note="Description of Unknown: Exemplary gene or splice site sequence"
auuguaugag

SEQ ID NO: 1006 - RNA, 10 nt, Unknown
  source: /note="Description of Unknown: Exemplary gene or splice site sequence"
auuguaugua

SEQ ID NO: 1007 - RNA, 10 nt, Unknown
  source: /note="Description of Unknown: Exemplary gene or splice site sequence"
auugucuguu

SEQ ID NO: 1008 - RNA, 10 nt, Unknown
  source: /note="Description of Unknown: Exemplary gene or splice site sequence"
auugugagcu

SEQ ID NO: 1009 - RNA, 10 nt, Unknown
  source: /note="Description of Unknown: Exemplary gene or splice site sequence"
auugugagua

SEQ ID NO: 1010 - RNA, 10 nt, Unknown
  source: /note="Description of Unknown: Exemplary gene or splice site sequence"
auugugaguc

SEQ ID NO: 1011 - RNA, 10 nt, Unknown
  source: /note="Description of Unknown: Exemplary gene or splice site sequence"
auugugaguu

SEQ ID NO: 1012 - RNA, 10 nt, Unknown
  source: /note="Description of Unknown: Exemplary gene or splice site sequence"
auugugcgug

SEQ ID NO: 1013 - RNA, 10 nt, Unknown
  source: /note="Description of Unknown: Exemplary gene or splice site sequence"
auugugggug

SEQ ID NO: 1014 - RNA, 10 nt, Unknown
  source: /note="Description of Unknown: Exemplary gene or splice site sequence"
auuguuagug

SEQ ID NO: 1015 - RNA, 10 nt, Unknown
  source: /note="Description of Unknown: Exemplary gene or splice site sequence"
caaguaaaaa

SEQ ID NO: 1016 - RNA, 10 nt, Unknown
  source: /note="Description of Unknown: Exemplary gene or splice site sequence"
caaguaaaua

SEQ ID NO: 1017 - RNA, 10 nt, Unknown
  source: /note="Description of Unknown: Exemplary gene or splice site sequence"
caaguaaauc

SEQ ID NO: 1018 - RNA, 10 nt, Unknown
  source: /note="Description of Unknown: Exemplary gene or splice site sequence"
caaguaaaug

SEQ ID NO: 1019 - RNA, 10 nt, Unknown
  source: /note="Description of Unknown: Exemplary gene or splice site sequence"
caaguaaccc

SEQ ID NO: 1020 - RNA, 10 nt, Unknown
  source: /note="Description of Unknown: Exemplary gene or splice site sequence"
caaguaacua

SEQ ID NO: 1021 - RNA, 10 nt, Unknown
  source: /note="Description of Unknown: Exemplary gene or splice site sequence"
caaguaacug

SEQ ID NO: 1022 - RNA, 10 nt, Unknown
  source: /note="Description of Unknown: Exemplary gene or splice site sequence"
caaguaagaa

SEQ ID NO: 1023 - RNA, 10 nt, Unknown
  source: /note="Description of Unknown: Exemplary gene or splice site sequence"
caaguaagac

SEQ ID NO: 1024 - RNA, 10 nt, Unknown
  source: /note="Description of Unknown: Exemplary gene or splice site sequence"
caaguaagau

SEQ ID NO: 1025 - RNA, 10 nt, Unknown
  source: /note="Description of Unknown: Exemplary gene or splice site sequence"
caaguaaggu

SEQ ID NO: 1026 - RNA, 10 nt, Unknown
  source: /note="Description of Unknown: Exemplary gene or splice site sequence"
caaguaagua

SEQ ID NO: 1027 - RNA, 10 nt, Unknown
  source: /note="Description of Unknown: Exemplary gene or splice site sequence"
caaguaaguc

SEQ ID NO: 1028 - RNA, 10 nt, Unknown
  source: /note="Description of Unknown: Exemplary gene or splice site sequence"
caaguaagug

SEQ ID NO: 1029 - RNA, 10 nt, Unknown
  source: /note="Description of Unknown: Exemplary gene or splice site sequence"
caaguaaguu

SEQ ID NO: 1030 - RNA, 10 nt, Unknown
  source: /note="Description of Unknown: Exemplary gene or splice site sequence"
caaguaaucc

SEQ ID NO: 1031 - RNA, 10 nt, Unknown
  source: /note="Description of Unknown: Exemplary gene or splice site sequence"
caaguaaucu

SEQ ID NO: 1032 - RNA, 10 nt, Unknown
  source: /note="Description of Unknown: Exemplary gene or splice site sequence"
caaguaauua

SEQ ID NO: 1033 - RNA, 10 nt, Unknown
  source: /note="Description of Unknown: Exemplary gene or splice site sequence"
caaguaauuc

SEQ ID NO: 1034 - RNA, 10 nt, Unknown
  source: /note="Description of Unknown: Exemplary gene or splice site sequence"
caaguaauug

SEQ ID NO: 1035 - RNA, 10 nt, Unknown
  source: /note="Description of Unknown: Exemplary gene or splice site sequence"
caaguaauuu

SEQ ID NO: 1036 - RNA, 10 nt, Unknown
  source: /note="Description of Unknown: Exemplary gene or splice site sequence"
caaguacaca

SEQ ID NO: 1037 - RNA, 10 nt, Unknown
  source: /note="Description of Unknown: Exemplary gene or splice site sequence"
caaguacguu

SEQ ID NO: 1038 - RNA, 10 nt, Unknown
  source: /note="Description of Unknown: Exemplary gene or splice site sequence"
caaguacuuu

SEQ ID NO: 1039 - RNA, 10 nt, Unknown
  source: /note="Description of Unknown: Exemplary gene or splice site sequence"
caaguagcug

SEQ ID NO: 1040 - RNA, 10 nt, Unknown
  source: /note="Description of Unknown: Exemplary gene or splice site sequence"
caaguaggau

SEQ ID NO: 1041 - RNA, 10 nt, Unknown
  source: /note="Description of Unknown: Exemplary gene or splice site sequence"
caaguaggua

SEQ ID NO: 1042 - RNA, 10 nt, Unknown
  source: /note="Description of Unknown: Exemplary gene or splice site sequence"
caaguagguc

SEQ ID NO: 1043 - RNA, 10 nt, Unknown
  source: /note="Description of Unknown: Exemplary gene or splice site sequence"
caaguaggug

SEQ ID NO: 1044 - RNA, 10 nt, Unknown
  source: /note="Description of Unknown: Exemplary gene or splice site sequence"
caaguagguu

SEQ ID NO: 1045 - RNA, 10 nt, Unknown
  source: /note="Description of Unknown: Exemplary gene or splice site sequence"
caaguaguuu

SEQ ID NO: 1046 - RNA, 10 nt, Unknown
  source: /note="Description of Unknown: Exemplary gene or splice site sequence"
caaguauaac

SEQ ID NO: 1047 - RNA, 10 nt, Unknown
  source: /note="Description of Unknown: Exemplary gene or splice site sequence"
caaguauaug

SEQ ID NO: 1048 - RNA, 10 nt, Unknown
  source: /note="Description of Unknown: Exemplary gene or splice site sequence"
caaguaucuu

SEQ ID NO: 1049 - RNA, 10 nt, Unknown
  source: /note="Description of Unknown: Exemplary gene or splice site sequence"
caaguaugag

SEQ ID NO: 1050 - RNA, 10 nt, Unknown
  source: /note="Description of Unknown: Exemplary gene or splice site sequence"
caaguaugua

SEQ ID NO: 1051 - RNA, 10 nt, Unknown
  source: /note="Description of Unknown: Exemplary gene or splice site sequence"
caaguauguc

SEQ ID NO: 1052 - RNA, 10 nt, Unknown
  source: /note="Description of Unknown: Exemplary gene or splice site sequence"
caaguaugug

SEQ ID NO: 1053 - RNA, 10 nt, Unknown
  source: /note="Description of Unknown: Exemplary gene or splice site sequence"
caaguauguu

SEQ ID NO: 1054 - RNA, 10 nt, Unknown
  source: /note="Description of Unknown: Exemplary gene or splice site sequence"
caaguauuga

SEQ ID NO: 1055 - RNA, 10 nt, Unknown
  source: /note="Description of Unknown: Exemplary gene or splice site sequence"
caaguauuuc

SEQ ID NO: 1056 - RNA, 10 nt, Unknown
  source: /note="Description of Unknown: Exemplary gene or splice site sequence"
caagucagac

SEQ ID NO: 1057 - RNA, 10 nt, Unknown
  source: /note="Description of Unknown: Exemplary gene or splice site sequence"
caagucagua

SEQ ID NO: 1058 - RNA, 10 nt, Unknown
  source: /note="Description of Unknown: Exemplary gene or splice site sequence"
caagucuaua

SEQ ID NO: 1059 - RNA, 10 nt, Unknown
  source: /note="Description of Unknown: Exemplary gene or splice site sequence"
caagucugau

SEQ ID NO: 1060 - RNA, 10 nt, Unknown
  source: /note="Description of Unknown: Exemplary gene or splice site sequence"
caagugacuu

SEQ ID NO: 1061 - RNA, 10 nt, Unknown
  source: /note="Description of Unknown: Exemplary gene or splice site sequence"
caagugagaa

SEQ ID NO: 1062 - RNA, 10 nt, Unknown
  source: /note="Description of Unknown: Exemplary gene or splice site sequence"
caagugagac

SEQ ID NO: 1063 - RNA, 10 nt, Unknown
  source: /note="Description of Unknown: Exemplary gene or splice site sequence"
caagugagca

SEQ ID NO: 1064 - RNA, 10 nt, Unknown
  source: /note="Description of Unknown: Exemplary gene or splice site sequence"
caagugaggc

SEQ ID NO: 1065 - RNA, 10 nt, Unknown
  source: /note="Description of Unknown: Exemplary gene or splice site sequence"
caagugaggg

SEQ ID NO: 1066 - RNA, 10 nt, Unknown
  source: /note="Description of Unknown: Exemplary gene or splice site sequence"
caagugagua

SEQ ID NO: 1067 - RNA, 10 nt, Unknown
  source: /note="Description of Unknown: Exemplary gene or splice site sequence"
caagugaguc

SEQ ID NO: 1068 - RNA, 10 nt, Unknown
  source: /note="Description of Unknown: Exemplary gene or splice site sequence"
caagugagug

SEQ ID NO: 1069 - RNA, 10 nt, Unknown
  source: /note="Description of Unknown: Exemplary gene or splice site sequence"
caagugaucc

SEQ ID NO: 1070 - RNA, 10 nt, Unknown
  source: /note="Description of Unknown: Exemplary gene or splice site sequence"
caagugaucu

SEQ ID NO: 1071 - RNA, 10 nt, Unknown
  source: /note="Description of Unknown: Exemplary gene or splice site sequence"
caagugauuc

SEQ ID NO: 1072 - RNA, 10 nt, Unknown
  source: /note="Description of Unknown: Exemplary gene or splice site sequence"
caagugauug

SEQ ID NO: 1073 - RNA, 10 nt, Unknown
  source: /note="Description of Unknown: Exemplary gene or splice site sequence"
caagugauuu

SEQ ID NO: 1074 - RNA, 10 nt, Unknown
  source: /note="Description of Unknown: Exemplary gene or splice site sequence"
caagugccuu

SEQ ID NO: 1075 - RNA, 10 nt, Unknown
  source: /note="Description of Unknown: Exemplary gene or splice site sequence"
caagugggua

SEQ ID NO: 1076 - RNA, 10 nt, Unknown
  source: /note="Description of Unknown: Exemplary gene or splice site sequence"
caaguggguc

SEQ ID NO: 1077 - RNA, 10 nt, Unknown
  source: /note="Description of Unknown: Exemplary gene or splice site sequence"
caagugggug

SEQ ID NO: 1078 - RNA, 10 nt, Unknown
  source: /note="Description of Unknown: Exemplary gene or splice site sequence"
caagugugag

SEQ ID NO: 1079 - RNA, 10 nt, Unknown
  source: /note="Description of Unknown: Exemplary gene or splice site sequence"
caaguuaaaa

SEQ ID NO: 1080 - RNA, 10 nt, Unknown
  source: /note="Description of Unknown: Exemplary gene or splice site sequence"
caaguuaagu

SEQ ID NO: 1081 - RNA, 10 nt, Unknown
  source: /note="Description of Unknown: Exemplary gene or splice site sequence"
caaguuaauc

SEQ ID NO: 1082 - RNA, 10 nt, Unknown
  source: /note="Description of Unknown: Exemplary gene or splice site sequence"
caaguuagaa

SEQ ID NO: 1083 - RNA, 10 nt, Unknown
  source: /note="Description of Unknown: Exemplary gene or splice site sequence"
caaguuaguu

SEQ ID NO: 1084 - RNA, 10 nt, Unknown
  source: /note="Description of Unknown: Exemplary gene or splice site sequence"
caaguucaag

SEQ ID NO: 1085 - RNA, 10 nt, Unknown
  source: /note="Description of Unknown: Exemplary gene or splice site sequence"
caaguuccgu

SEQ ID NO: 1086 - RNA, 10 nt, Unknown
  source: /note="Description of Unknown: Exemplary gene or splice site sequence"
caaguuggua

SEQ ID NO: 1087 - RNA, 10 nt, Unknown
  source: /note="Description of Unknown: Exemplary gene or splice site sequence"
caaguuuagu

SEQ ID NO: 1088 - RNA, 10 nt, Unknown
  source: /note="Description of Unknown: Exemplary gene or splice site sequence"
caaguuucca

SEQ ID NO: 1089 - RNA, 10 nt, Unknown
  source: /note="Description of Unknown: Exemplary gene or splice site sequence"
caaguuuguu

SEQ ID NO: 1090 - RNA, 10 nt, Unknown
  source: /note="Description of Unknown: Exemplary gene or splice site sequence"
cacguaagag

SEQ ID NO: 1091 - RNA, 10 nt, Unknown
  source: /note="Description of Unknown: Exemplary gene or splice site sequence"
cacguaagca

SEQ ID NO: 1092 - RNA, 10 nt, Unknown
  source: /note="Description of Unknown: Exemplary gene or splice site sequence"
cacguaauug

SEQ ID NO: 1093 - RNA, 10 nt, Unknown
  source: /note="Description of Unknown: Exemplary gene or splice site sequence"
cacguaggac

SEQ ID NO: 1094 - RNA, 10 nt, Unknown
  source: /note="Description of Unknown: Exemplary gene or splice site sequence"
cacguaucga

SEQ ID NO: 1095 - RNA, 10 nt, Unknown
  source: /note="Description of Unknown: Exemplary gene or splice site sequence"
cacgucaguu

SEQ ID NO: 1096 - RNA, 10 nt, Unknown
  source: /note="Description of Unknown: Exemplary gene or splice site sequence"
cacgugagcu

SEQ ID NO: 1097 - RNA, 10 nt, Unknown
  source: /note="Description of Unknown: Exemplary gene or splice site sequence"
cacgugaguc

SEQ ID NO: 1098 - RNA, 10 nt, Unknown
  source: /note="Description of Unknown: Exemplary gene or splice site sequence"
cacgugagug

SEQ ID NO: 1099 - RNA, 10 nt, Unknown
  source: /note="Description of Unknown: Exemplary gene or splice site sequence"
caggcaagaa

SEQ ID NO: 1100 - RNA, 10 nt, Unknown
  source: /note="Description of Unknown: Exemplary gene or splice site sequence"
caggcaagac

SEQ ID NO: 1101 - RNA, 10 nt, Unknown
  source: /note="Description of Unknown: Exemplary gene or splice site sequence"
caggcaagag

SEQ ID NO: 1102 - RNA, 10 nt, Unknown
  source: /note="Description of Unknown: Exemplary gene or splice site sequence"
caggcaagga

SEQ ID NO: 1103 - RNA, 10 nt, Unknown
  source: /note="Description of Unknown: Exemplary gene or splice site sequence"
caggcaagua

SEQ ID NO: 1104 - RNA, 10 nt, Unknown
  source: /note="Description of Unknown: Exemplary gene or splice site sequence"
caggcaagug

SEQ ID NO: 1105 - RNA, 10 nt, Unknown
  source: /note="Description of Unknown: Exemplary gene or splice site sequence"
caggcaaguu

SEQ ID NO: 1106 - RNA, 10 nt, Unknown
  source: /note="Description of Unknown: Exemplary gene or splice site sequence"
caggcacgca

SEQ ID NO: 1107 - RNA, 10 nt, Unknown
  source: /note="Description of Unknown: Exemplary gene or splice site sequence"
caggcagagg

SEQ ID NO: 1108 - RNA, 10 nt, Unknown
  source: /note="Description of Unknown: Exemplary gene or splice site sequence"
caggcaggug

SEQ ID NO: 1109 - RNA, 10 nt, Unknown
  source: /note="Description of Unknown: Exemplary gene or splice site sequence"
caggcaucau

SEQ ID NO: 1110 - RNA, 10 nt, Unknown
  source: /note="Description of Unknown: Exemplary gene or splice site sequence"
caggcaugaa

SEQ ID NO: 1111 - RNA, 10 nt, Unknown
  source: /note="Description of Unknown: Exemplary gene or splice site sequence"
caggcaugag

SEQ ID NO: 1112 - RNA, 10 nt, Unknown
  source: /note="Description of Unknown: Exemplary gene or splice site sequence"
caggcaugca

SEQ ID NO: 1113 - RNA, 10 nt, Unknown
  source: /note="Description of Unknown: Exemplary gene or splice site sequence"
caggcaugcg

SEQ ID NO: 1114 - RNA, 10 nt, Unknown
  source: /note="Description of Unknown: Exemplary gene or splice site sequence"
caggcaugug

SEQ ID NO: 1115 - RNA, 10 nt, Unknown
  source: /note="Description of Unknown: Exemplary gene or splice site sequence"
caggcgagag

SEQ ID NO: 1116 - RNA, 10 nt, Unknown
  source: /note="Description of Unknown: Exemplary gene or splice site sequence"
caggcgccug

SEQ ID NO: 1117 - RNA, 10 nt, Unknown
  source: /note="Description of Unknown: Exemplary gene or splice site sequence"
caggcgugug

SEQ ID NO: 1118 - RNA, 10 nt, Unknown
  source: /note="Description of Unknown: Exemplary gene or splice site sequence"
cagguaaaaa

SEQ ID NO: 1119 - RNA, 10 nt, Unknown
  source: /note="Description of Unknown: Exemplary gene or splice site sequence"
cagguaaaag

SEQ ID NO: 1120 - RNA, 10 nt, Unknown
  source: /note="Description of Unknown: Exemplary gene or splice site sequence"
cagguaaaca

SEQ ID NO: 1121 - RNA, 10 nt, Unknown
  source: /note="Description of Unknown: Exemplary gene or splice site sequence"
cagguaaacc

SEQ ID NO: 1122 - RNA, 10 nt, Unknown
  source: /note="Description of Unknown: Exemplary gene or splice site sequence"
cagguaaaga

SEQ ID NO: 1123 - RNA, 10 nt, Unknown
  source: /note="Description of Unknown: Exemplary gene or splice site sequence"
cagguaaagc

SEQ ID NO: 1124 - RNA, 10 nt, Unknown
  source: /note="Description of Unknown: Exemplary gene or splice site sequence"
cagguaaagu

SEQ ID NO: 1125 - RNA, 10 nt, Unknown
  source: /note="Description of Unknown: Exemplary gene or splice site sequence"
cagguaaaua

SEQ ID NO: 1126 - RNA, 10 nt, Unknown
  source: /note="Description of Unknown: Exemplary gene or splice site sequence"
cagguaaauc

SEQ ID NO: 1127 - RNA, 10 nt, Unknown
  source: /note="Description of Unknown: Exemplary gene or splice site sequence"
cagguaaaug

SEQ ID NO: 1128 - RNA, 10 nt, Unknown
  source: /note="Description of Unknown: Exemplary gene or splice site sequence"
cagguaaauu

SEQ ID NO: 1129 - RNA, 10 nt, Unknown
  source: /note="Description of Unknown: Exemplary gene or splice site sequence"
cagguaacag

SEQ ID NO: 1130 - RNA, 10 nt, Unknown
  source: /note="Description of Unknown: Exemplary gene or splice site sequence"
cagguaacau

SEQ ID NO: 1131 - RNA, 10 nt, Unknown
  source: /note="Description of Unknown: Exemplary gene or splice site sequence"
cagguaacca

SEQ ID NO: 1132 - RNA, 10 nt, Unknown
  source: /note="Description of Unknown: Exemplary gene or splice site sequence"
cagguaaccg

SEQ ID NO: 1133 - RNA, 10 nt, Unknown
  source: /note="Description of Unknown: Exemplary gene or splice site sequence"
cagguaacgu

SEQ ID NO: 1134 - RNA, 10 nt, Unknown
  source: /note="Description of Unknown: Exemplary gene or splice site sequence"
cagguaacua

SEQ ID NO: 1135 - RNA, 10 nt, Unknown
  source: /note="Description of Unknown: Exemplary gene or splice site sequence"
cagguaacuc

SEQ ID NO: 1136 - RNA, 10 nt, Unknown
  source: /note="Description of Unknown: Exemplary gene or splice site sequence"
cagguaacug

SEQ ID NO: 1137 - RNA, 10 nt, Unknown
  source: /note="Description of Unknown: Exemplary gene or splice site sequence"
cagguaacuu

SEQ ID NO: 1138 - RNA, 10 nt, Unknown
  source: /note="Description of Unknown: Exemplary gene or splice site sequence"
cagguaagaa

SEQ ID NO: 1139 - RNA, 10 nt, Unknown
  source: /note="Description of Unknown: Exemplary gene or splice site sequence"
cagguaagac

SEQ ID NO: 1140 - RNA, 10 nt, Unknown
  source: /note="Description of Unknown: Exemplary gene or splice site sequence"
cagguaagag

SEQ ID NO: 1141 - RNA, 10 nt, Unknown
  source: /note="Description of Unknown: Exemplary gene or splice site sequence"
cagguaagau

SEQ ID NO: 1142 - RNA, 10 nt, Unknown
  source: /note="Description of Unknown: Exemplary gene or splice site sequence"
cagguaagcc

SEQ ID NO: 1143 - RNA, 10 nt, Unknown
  source: /note="Description of Unknown: Exemplary gene or splice site sequence"
cagguaagga

SEQ ID NO: 1144 - RNA, 10 nt, Unknown
  source: /note="Description of Unknown: Exemplary gene or splice site sequence"
cagguaaggc

SEQ ID NO: 1145 - RNA, 10 nt, Unknown
  source: /note="Description of Unknown: Exemplary gene or splice site sequence"
cagguaaggg

SEQ ID NO: 1146 - RNA, 10 nt, Unknown
  source: /note="Description of Unknown: Exemplary gene or splice site sequence"
cagguaaggu

SEQ ID NO: 1147 - RNA, 10 nt, Unknown
  source: /note="Description of Unknown: Exemplary gene or splice site sequence"
cagguaagua

SEQ ID NO: 1148 - RNA, 10 nt, Unknown
  source: /note="Description of Unknown: Exemplary gene or splice site sequence"
cagguaagug

SEQ ID NO: 1149 - RNA, 10 nt, Unknown
  source: /note="Description of Unknown: Exemplary gene or splice site sequence"
cagguaaguu

SEQ ID NO: 1150 - RNA, 10 nt, Unknown
  source: /note="Description of Unknown: Exemplary gene or splice site sequence"
cagguaauaa

SEQ ID NO: 1151 - RNA, 10 nt, Unknown
  source: /note="Description of Unknown: Exemplary gene or splice site sequence"
cagguaauau

SEQ ID NO: 1152 - RNA, 10 nt, Unknown
  source: /note="Description of Unknown: Exemplary gene or splice site sequence"
cagguaaucc

SEQ ID NO: 1153 - RNA, 10 nt, Unknown
  source: /note="Description of Unknown: Exemplary gene or splice site sequence"
cagguaaugc

SEQ ID NO: 1154 - RNA, 10 nt, Unknown
  source: /note="Description of Unknown: Exemplary gene or splice site sequence"
cagguaaugg

SEQ ID NO: 1155 - RNA, 10 nt, Unknown
  source: /note="Description of Unknown: Exemplary gene or splice site sequence"
cagguaaugu

SEQ ID NO: 1156 - RNA, 10 nt, Unknown
  source: /note="Description of Unknown: Exemplary gene or splice site sequence"
cagguaauua

SEQ ID NO: 1157 - RNA, 10 nt, Unknown
  source: /note="Description of Unknown: Exemplary gene or splice site sequence"
cagguaauuc

SEQ ID NO: 1158 - RNA, 10 nt, Unknown
  source: /note="Description of Unknown: Exemplary gene or splice site sequence"
cagguaauug

SEQ ID NO: 1159 - RNA, 10 nt, Unknown
  source: /note="Description of Unknown: Exemplary gene or splice site sequence"
cagguaauuu

SEQ ID NO: 1160 - RNA, 10 nt, Unknown
  source: /note="Description of Unknown: Exemplary gene or splice site sequence"
cagguacaaa

SEQ ID NO: 1161 - RNA, 10 nt, Unknown
  source: /note="Description of Unknown: Exemplary gene or splice site sequence"
cagguacaag

SEQ ID NO: 1162 - RNA, 10 nt, Unknown
  source: /note="Description of Unknown: Exemplary gene or splice site sequence"
cagguacaau

SEQ ID NO: 1163 - RNA, 10 nt, Unknown
  source: /note="Description of Unknown: Exemplary gene or splice site sequence"
cagguacaca

SEQ ID NO: 1164 - RNA, 10 nt, Unknown
  source: /note="Description of Unknown: Exemplary gene or splice site sequence"
cagguacacg

SEQ ID NO: 1165 - RNA, 10 nt, Unknown
  source: /note="Description of Unknown: Exemplary gene or splice site sequence"
cagguacaga

SEQ ID NO: 1166 - RNA, 10 nt, Unknown
  source: /note="Description of Unknown: Exemplary gene or splice site sequence"
cagguacagg

SEQ ID NO: 1167 - RNA, 10 nt, Unknown
  source: /note="Description of Unknown: Exemplary gene or splice site sequence"
cagguacagu

SEQ ID NO: 1168 - RNA, 10 nt, Unknown
  source: /note="Description of Unknown: Exemplary gene or splice site sequence"
cagguacaua

SEQ ID NO: 1169 - RNA, 10 nt, Unknown
  source: /note="Description of Unknown: Exemplary gene or splice site sequence"
cagguacaug

SEQ ID NO: 1170 - RNA, 10 nt, Unknown
  source: /note="Description of Unknown: Exemplary gene or splice site sequence"
cagguacauu

SEQ ID NO: 1171 - RNA, 10 nt, Unknown
  source: /note="Description of Unknown: Exemplary gene or splice site sequence"
cagguaccac

SEQ ID NO: 1172 - RNA, 10 nt, Unknown
  source: /note="Description of Unknown: Exemplary gene or splice site sequence"
cagguaccca

SEQ ID NO: 1173 - RNA, 10 nt, Unknown
  source: /note="Description of Unknown: Exemplary gene or splice site sequence"
cagguacccg

SEQ ID NO: 1174 - RNA, 10 nt, Unknown
  source: /note="Description of Unknown: Exemplary gene or splice site sequence"
cagguacccu

SEQ ID NO: 1175 - RNA, 10 nt, Unknown
  source: /note="Description of Unknown: Exemplary gene or splice site sequence"
cagguaccgc

SEQ ID NO: 1176 - RNA, 10 nt, Unknown
  source: /note="Description of Unknown: Exemplary gene or splice site sequence"
cagguaccgg

SEQ ID NO: 1177 - RNA, 10 nt, Unknown
  source: /note="Description of Unknown: Exemplary gene or splice site sequence"
cagguaccuc

SEQ ID NO: 1178 - RNA, 10 nt, Unknown
  source: /note="Description of Unknown: Exemplary gene or splice site sequence"
cagguaccug

SEQ ID NO: 1179 - RNA, 10 nt, Unknown
  source: /note="Description of Unknown: Exemplary gene or splice site sequence"
cagguaccuu

SEQ ID NO: 1180 - RNA, 10 nt, Unknown
  source: /note="Description of Unknown: Exemplary gene or splice site sequence"
cagguacgag

SEQ ID NO: 1181 - RNA, 10 nt, Unknown
  source: /note="Description of Unknown: Exemplary gene or splice site sequence"
cagguacgca

SEQ ID NO: 1182 - RNA, 10 nt, Unknown
  source: /note="Description of Unknown: Exemplary gene or splice site sequence"
cagguacgcc

SEQ ID NO: 1183 - RNA, 10 nt, Unknown
  source: /note="Description of Unknown: Exemplary gene or splice site sequence"
cagguacggu

SEQ ID NO: 1184 - RNA, 10 nt, Unknown
  source: /note="Description of Unknown: Exemplary gene or splice site sequence"
cagguacgua

SEQ ID NO: 1185 - RNA, 10 nt, Unknown
  source: /note="Description of Unknown: Exemplary gene or splice site sequence"
cagguacgug

SEQ ID NO: 1186 - RNA, 10 nt, Unknown
  source: /note="Description of Unknown: Exemplary gene or splice site sequence"
cagguacuaa

SEQ ID NO: 1187 - RNA, 10 nt, Unknown
  source: /note="Description of Unknown: Exemplary gene or splice site sequence"
cagguacuag

SEQ ID NO: 1188 - RNA, 10 nt, Unknown
  source: /note="Description of Unknown: Exemplary gene or splice site sequence"
cagguacuau

SEQ ID NO: 1189 - RNA, 10 nt, Unknown
  source: /note="Description of Unknown: Exemplary gene or splice site sequence"
cagguacucc

SEQ ID NO: 1190 - RNA, 10 nt, Unknown
  source: /note="Description of Unknown: Exemplary gene or splice site sequence"
cagguacucu

SEQ ID NO: 1191 - RNA, 10 nt, Unknown
  source: /note="Description of Unknown: Exemplary gene or splice site sequence"
cagguacuga

SEQ ID NO: 1192 - RNA, 10 nt, Unknown
  source: /note="Description of Unknown: Exemplary gene or splice site sequence"
cagguacugc

SEQ ID NO: 1193 - RNA, 10 nt, Unknown
  source: /note="Description of Unknown: Exemplary gene or splice site sequence"
cagguacugu

SEQ ID NO: 1194 - RNA, 10 nt, Unknown
  source: /note="Description of Unknown: Exemplary gene or splice site sequence"
cagguacuua

SEQ ID NO: 1195 - RNA, 10 nt, Unknown
  source: /note="Description of Unknown: Exemplary gene or splice site sequence"
cagguacuuu

SEQ ID NO: 1196 - RNA, 10 nt, Unknown
  source: /note="Description of Unknown: Exemplary gene or splice site sequence"
cagguagaaa

SEQ ID NO: 1197 - RNA, 10 nt, Unknown
  source: /note="Description of Unknown: Exemplary gene or splice site sequence"
cagguagaac

SEQ ID NO: 1198 - RNA, 10 nt, Unknown
  source: /note="Description of Unknown: Exemplary gene or splice site sequence"
cagguagaag

SEQ ID NO: 1199 - RNA, 10 nt, Unknown
  source: /note="Description of Unknown: Exemplary gene or splice site sequence"
cagguagaca

SEQ ID NO: 1200 - RNA, 10 nt, Unknown
  source: /note="Description of Unknown: Exemplary gene or splice site sequence"
cagguagacc

SEQ ID NO: 1201 - RNA, 10 nt, Unknown
  source: /note="Description of Unknown: Exemplary gene or splice site sequence"
cagguagaga

SEQ ID NO: 1202 - RNA, 10 nt, Unknown
  source: /note="Description of Unknown: Exemplary gene or splice site sequence"
cagguagauu

SEQ ID NO: 1203 - RNA, 10 nt, Unknown
  source: /note="Description of Unknown: Exemplary gene or splice site sequence"
cagguagcaa

SEQ ID NO: 1204 - RNA, 10 nt, Unknown
  source: /note="Description of Unknown: Exemplary gene or splice site sequence"
cagguagcac

SEQ ID NO: 1205 - RNA, 10 nt, Unknown
  source: /note="Description of Unknown: Exemplary gene or splice site sequence"
cagguagcag

SEQ ID NO: 1206 - RNA, 10 nt, Unknown
  source: /note="Description of Unknown: Exemplary gene or splice site sequence"
cagguagcca

SEQ ID NO: 1207 - RNA, 10 nt, Unknown
  source: /note="Description of Unknown: Exemplary gene or splice site sequence"
cagguagcgu

SEQ ID NO: 1208 - RNA, 10 nt, Unknown
  source: /note="Description of Unknown: Exemplary gene or splice site sequence"
cagguagcua

SEQ ID NO: 1209 - RNA, 10 nt, Unknown
  source: /note="Description of Unknown: Exemplary gene or splice site sequence"
cagguagcuc

SEQ ID NO: 1210 - RNA, 10 nt, Unknown
  source: /note="Description of Unknown: Exemplary gene or splice site sequence"
cagguagcug

SEQ ID NO: 1211 - RNA, 10 nt, Unknown
  source: /note="Description of Unknown: Exemplary gene or splice site sequence"
cagguagcuu

SEQ ID NO: 1212 - RNA, 10 nt, Unknown
  source: /note="Description of Unknown: Exemplary gene or splice site sequence"
cagguaggaa

SEQ ID NO: 1213 - RNA, 10 nt, Unknown
  source: /note="Description of Unknown: Exemplary gene or splice site sequence"
cagguaggac

SEQ ID NO: 1214 - RNA, 10 nt, Unknown
  source: /note="Description of Unknown: Exemplary gene or splice site sequence"
cagguaggag

SEQ ID NO: 1215 - RNA, 10 nt, Unknown
  source: /note="Description of Unknown: Exemplary gene or splice site sequence"
cagguaggca

SEQ ID NO: 1216 - RNA, 10 nt, Unknown
  source: /note="Description of Unknown: Exemplary gene or splice site sequence"
cagguaggga

SEQ ID NO: 1217 - RNA, 10 nt, Unknown
  source: /note="Description of Unknown: Exemplary gene or splice site sequence"
cagguagggc

SEQ ID NO: 1218 - RNA, 10 nt, Unknown
  source: /note="Description of Unknown: Exemplary gene or splice site sequence"
cagguagggg

SEQ ID NO: 1219 - RNA, 10 nt, Unknown
  source: /note="Description of Unknown: Exemplary gene or splice site sequence"
cagguagggu

SEQ ID NO: 1220 - RNA, 10 nt, Unknown
  source: /note="Description of Unknown: Exemplary gene or splice site sequence"
cagguaggua

SEQ ID NO: 1221 - RNA, 10 nt, Unknown
  source: /note="Description of Unknown: Exemplary gene or splice site sequence"
cagguagguc

SEQ ID NO: 1222 - RNA, 10 nt, Unknown
  source: /note="Description of Unknown: Exemplary gene or splice site sequence"
cagguaggug

SEQ ID NO: 1223 - RNA, 10 nt, Unknown
  source: /note="Description of Unknown: Exemplary gene or splice site sequence"
cagguagguu

SEQ ID NO: 1224 - RNA, 10 nt, Unknown
  source: /note="Description of Unknown: Exemplary gene or splice site sequence"
cagguaguaa

SEQ ID NO: 1225 - RNA, 10 nt, Unknown
  source: /note="Description of Unknown: Exemplary gene or splice site sequence"
cagguaguau

SEQ ID NO: 1226 - RNA, 10 nt, Unknown
  source: /note="Description of Unknown: Exemplary gene or splice site sequence"
cagguaguca

SEQ ID NO: 1227 - RNA, 10 nt, Unknown
  source: /note="Description of Unknown: Exemplary gene or splice site sequence"
cagguagucc

SEQ ID NO: 1228 - RNA, 10 nt, Unknown
  source: /note="Description of Unknown: Exemplary gene or splice site sequence"
cagguaguga

SEQ ID NO: 1229 - RNA, 10 nt, Unknown
  source: /note="Description of Unknown: Exemplary gene or splice site sequence"
cagguagugu

SEQ ID NO: 1230 - RNA, 10 nt, Unknown
  source: /note="Description of Unknown: Exemplary gene or splice site sequence"
cagguaguuc

SEQ ID NO: 1231 - RNA, 10 nt, Unknown
  source: /note="Description of Unknown: Exemplary gene or splice site sequence"
cagguaguug

SEQ ID NO: 1232 - RNA, 10 nt, Unknown
  source: /note="Description of Unknown: Exemplary gene or splice site sequence"
cagguaguuu

SEQ ID NO: 1233 - RNA, 10 nt, Unknown
  source: /note="Description of Unknown: Exemplary gene or splice site sequence"
cagguauaag

SEQ ID NO: 1234 - RNA, 10 nt, Unknown
  source: /note="Description of Unknown: Exemplary gene or splice site sequence"
cagguauaca

SEQ ID NO: 1235 - RNA, 10 nt, Unknown
  source: /note="Description of Unknown: Exemplary gene or splice site sequence"
cagguauaga

SEQ ID NO: 1236 - RNA, 10 nt, Unknown
  source: /note="Description of Unknown: Exemplary gene or splice site sequence"
cagguauauc

SEQ ID NO: 1237 - RNA, 10 nt, Unknown
  source: /note="Description of Unknown: Exemplary gene or splice site sequence"
cagguauaug

SEQ ID NO: 1238 - RNA, 10 nt, Unknown
  source: /note="Description of Unknown: Exemplary gene or splice site sequence"
cagguauauu

SEQ ID NO: 1239 - RNA, 10 nt, Unknown
  source: /note="Description of Unknown: Exemplary gene or splice site sequence"
cagguaucag

SEQ ID NO: 1240 - RNA, 10 nt, Unknown
  source: /note="Description of Unknown: Exemplary gene or splice site sequence"
cagguaucau

SEQ ID NO: 1241 - RNA, 10 nt, Unknown
  source: /note="Description of Unknown: Exemplary gene or splice site sequence"
cagguauccu

SEQ ID NO: 1242 - RNA, 10 nt, Unknown
  source: /note="Description of Unknown: Exemplary gene or splice site sequence"
cagguaucga

SEQ ID NO: 1243 - RNA, 10 nt, Unknown
  source: /note="Description of Unknown: Exemplary gene or splice site sequence"
cagguaucgc

SEQ ID NO: 1244 - RNA, 10 nt, Unknown
  source: /note="Description of Unknown: Exemplary gene or splice site sequence"
cagguaucua

SEQ ID NO: 1245 - RNA, 10 nt, Unknown
  source: /note="Description of Unknown: Exemplary gene or splice site sequence"
cagguaucug

SEQ ID NO: 1246 - RNA, 10 nt, Unknown
  source: /note="Description of Unknown: Exemplary gene or splice site sequence"
cagguaucuu

SEQ ID NO: 1247 - RNA, 10 nt, Unknown
  source: /note="Description of Unknown: Exemplary gene or splice site sequence"
cagguaugaa

SEQ ID NO: 1248 - RNA, 10 nt, Unknown
  source: /note="Description of Unknown: Exemplary gene or splice site sequence"
cagguaugac

SEQ ID NO: 1249 - RNA, 10 nt, Unknown
  source: /note="Description of Unknown: Exemplary gene or splice site sequence"
cagguaugag

SEQ ID NO: 1250 - RNA, 10 nt, Unknown
  source: /note="Description of Unknown: Exemplary gene or splice site sequence"
cagguaugau

SEQ ID NO: 1251 - RNA, 10 nt, Unknown
  source: /note="Description of Unknown: Exemplary gene or splice site sequence"
cagguaugca

SEQ ID NO: 1252 - RNA, 10 nt, Unknown
  source: /note="Description of Unknown: Exemplary gene or splice site sequence"
cagguaugcc

SEQ ID NO: 1253 - RNA, 10 nt, Unknown
  source: /note="Description of Unknown: Exemplary gene or splice site sequence"
cagguaugcg

SEQ ID NO: 1254 - RNA, 10 nt, Unknown
  source: /note="Description of Unknown: Exemplary gene or splice site sequence"
cagguaugcu

SEQ ID NO: 1255 - RNA, 10 nt, Unknown
  source: /note="Description of Unknown: Exemplary gene or splice site sequence"
cagguaugga

SEQ ID NO: 1256 - RNA, 10 nt, Unknown
  source: /note="Description of Unknown: Exemplary gene or splice site sequence"
cagguauggg

SEQ ID NO: 1257 - RNA, 10 nt, Unknown
  source: /note="Description of Unknown: Exemplary gene or splice site sequence"
cagguauggu

SEQ ID NO: 1258 - RNA, 10 nt, Unknown
  source: /note="Description of Unknown: Exemplary gene or splice site sequence"
cagguaugua

SEQ ID NO: 1259 - RNA, 10 nt, Unknown
  source: /note="Description of Unknown: Exemplary gene or splice site sequence"
cagguauguc

SEQ ID NO: 1260 - RNA, 10 nt, Unknown
  source: /note="Description of Unknown: Exemplary gene or splice site sequence"
cagguaugug

SEQ ID NO: 1261 - RNA, 10 nt, Unknown
  source: /note="Description of Unknown: Exemplary gene or splice site sequence"
cagguauguu

SEQ ID NO: 1262 - RNA, 10 nt, Unknown
  source: /note="Description of Unknown: Exemplary gene or splice site sequence"
cagguauuau

SEQ ID NO: 1263 - RNA, 10 nt, Unknown
  source: /note="Description of Unknown: Exemplary gene or splice site sequence"
cagguauuca

SEQ ID NO: 1264 - RNA, 10 nt, Unknown
  source: /note="Description of Unknown: Exemplary gene or splice site sequence"
cagguauucu

SEQ ID NO: 1265 - RNA, 10 nt, Unknown
  source: /note="Description of Unknown: Exemplary gene or splice site sequence"
cagguauuga

SEQ ID NO: 1266 - RNA, 10 nt, Unknown
  source: /note="Description of Unknown: Exemplary gene or splice site sequence"
cagguauugg

SEQ ID NO: 1267 - RNA, 10 nt, Unknown
  source: /note="Description of Unknown: Exemplary gene or splice site sequence"
cagguauugu

SEQ ID NO: 1268 - RNA, 10 nt, Unknown
  source: /note="Description of Unknown: Exemplary gene or splice site sequence"
cagguauuua

SEQ ID NO: 1269 - RNA, 10 nt, Unknown
  source: /note="Description of Unknown: Exemplary gene or splice site sequence"
cagguauuuc

SEQ ID NO: 1270 - RNA, 10 nt, Unknown
  source: /note="Description of Unknown: Exemplary gene or splice site sequence"
cagguauuug

SEQ ID NO: 1271 - RNA, 10 nt, Unknown
  source: /note="Description of Unknown: Exemplary gene or splice site sequence"
cagguauuuu

SEQ ID NO: 1272 - RNA, 10 nt, Unknown
  source: /note="Description of Unknown: Exemplary gene or splice site sequence"
caggucaaca

SEQ ID NO: 1273 - RNA, 10 nt, Unknown
  source: /note="Description of Unknown: Exemplary gene or splice site sequence"
caggucaaug

SEQ ID NO: 1274 - RNA, 10 nt, Unknown
  source: /note="Description of Unknown: Exemplary gene or splice site sequence"
caggucacgu

SEQ ID NO: 1275 - RNA, 10 nt, Unknown
  source: /note="Description of Unknown: Exemplary gene or splice site sequence"
caggucagaa

SEQ ID NO: 1276 - RNA, 10 nt, Unknown
  source: /note="Description of Unknown: Exemplary gene or splice site sequence"
caggucagac

SEQ ID NO: 1277 - RNA, 10 nt, Unknown
  source: /note="Description of Unknown: Exemplary gene or splice site sequence"
caggucagca

SEQ ID NO: 1278 - RNA, 10 nt, Unknown
  source: /note="Description of Unknown: Exemplary gene or splice site sequence"
caggucagcc

SEQ ID NO: 1279 - RNA, 10 nt, Unknown
  source: /note="Description of Unknown: Exemplary gene or splice site sequence"
caggucagcg

SEQ ID NO: 1280 - RNA, 10 nt, Unknown
  source: /note="Description of Unknown: Exemplary gene or splice site sequence"
caggucagga

SEQ ID NO: 1281 - RNA, 10 nt, Unknown
  source: /note="Description of Unknown: Exemplary gene or splice site sequence"
caggucagua

SEQ ID NO: 1282 - RNA, 10 nt, Unknown
  source: /note="Description of Unknown: Exemplary gene or splice site sequence"
caggucaguc

SEQ ID NO: 1283 - RNA, 10 nt, Unknown
  source: /note="Description of Unknown: Exemplary gene or splice site sequence"
caggucagug

SEQ ID NO: 1284 - RNA, 10 nt, Unknown
  source: /note="Description of Unknown: Exemplary gene or splice site sequence"
caggucaguu

SEQ ID NO: 1285 - RNA, 10 nt, Unknown
  source: /note="Description of Unknown: Exemplary gene or splice site sequence"
caggucaucc

SEQ ID NO: 1286 - RNA, 10 nt, Unknown
  source: /note="Description of Unknown: Exemplary gene or splice site sequence"
caggucaugc

SEQ ID NO: 1287 - RNA, 10 nt, Unknown
  source: /note="Description of Unknown: Exemplary gene or splice site sequence"
caggucauua

SEQ ID NO: 1288 - RNA, 10 nt, Unknown
  source: /note="Description of Unknown: Exemplary gene or splice site sequence"
caggucauuu

SEQ ID NO: 1289 - RNA, 10 nt, Unknown
  source: /note="Description of Unknown: Exemplary gene or splice site sequence"
cagguccacc

SEQ ID NO: 1290 - RNA, 10 nt, Unknown
  source: /note="Description of Unknown: Exemplary gene or splice site sequence"
cagguccacu

SEQ ID NO: 1291 - RNA, 10 nt, Unknown
  source: /note="Description of Unknown: Exemplary gene or splice site sequence"
cagguccagu

SEQ ID NO: 1292 - RNA, 10 nt, Unknown
  source: /note="Description of Unknown: Exemplary gene or splice site sequence"
cagguccauc

SEQ ID NO: 1293 - RNA, 10 nt, Unknown
  source: /note="Description of Unknown: Exemplary gene or splice site sequence"
cagguccauu

SEQ ID NO: 1294 - RNA, 10 nt, Unknown
  source: /note="Description of Unknown: Exemplary gene or splice site sequence"
caggucccag

SEQ ID NO: 1295 - RNA, 10 nt, Unknown
  source: /note="Description of Unknown: Exemplary gene or splice site sequence"
caggucccug

SEQ ID NO: 1296 - RNA, 10 nt, Unknown
  source: /note="Description of Unknown: Exemplary gene or splice site sequence"
cagguccuga

SEQ ID NO: 1297 - RNA, 10 nt, Unknown
  source: /note="Description of Unknown: Exemplary gene or splice site sequence"
cagguccugc

SEQ ID NO: 1298 - RNA, 10 nt, Unknown
  source: /note="Description of Unknown: Exemplary gene or splice site sequence"
cagguccugg

SEQ ID NO: 1299 - RNA, 10 nt, Unknown
  source: /note="Description of Unknown: Exemplary gene or splice site sequence"
caggucggcc

SEQ ID NO: 1300 - RNA, 10 nt, Unknown
  source: /note="Description of Unknown: Exemplary gene or splice site sequence"
caggucggug

SEQ ID NO: 1301 - RNA, 10 nt, Unknown
  source: /note="Description of Unknown: Exemplary gene or splice site sequence"
caggucguug

SEQ ID NO: 1302 - RNA, 10 nt, Unknown
  source: /note="Description of Unknown: Exemplary gene or splice site sequence"
caggucucuc

SEQ ID NO: 1303 - RNA, 10 nt, Unknown
  source: /note="Description of Unknown: Exemplary gene or splice site sequence"
caggucucuu

SEQ ID NO: 1304 - RNA, 10 nt, Unknown
  source: /note="Description of Unknown: Exemplary gene or splice site sequence"
caggucugag

SEQ ID NO: 1305 - RNA, 10 nt, Unknown
  source: /note="Description of Unknown: Exemplary gene or splice site sequence"
caggucugcc

SEQ ID NO: 1306 - RNA, 10 nt, Unknown
  source: /note="Description of Unknown: Exemplary gene or splice site sequence"
caggucugcg

SEQ ID NO: 1307 - RNA, 10 nt, Unknown
  source: /note="Description of Unknown: Exemplary gene or splice site sequence"
caggucugga

SEQ ID NO: 1308 - RNA, 10 nt, Unknown
  source: /note="Description of Unknown: Exemplary gene or splice site sequence"
caggucuggu

SEQ ID NO: 1309 - RNA, 10 nt, Unknown
  source: /note="Description of Unknown: Exemplary gene or splice site sequence"
caggucugua

SEQ ID NO: 1310 - RNA, 10 nt, Unknown
  source: /note="Description of Unknown: Exemplary gene or splice site sequence"
caggucuguc

SEQ ID NO: 1311 - RNA, 10 nt, Unknown
  source: /note="Description of Unknown: Exemplary gene or splice site sequence"
caggucugug

SEQ ID NO: 1312 - RNA, 10 nt, Unknown
  source: /note="Description of Unknown: Exemplary gene or splice site sequence"
caggucuguu

SEQ ID NO: 1313 - RNA, 10 nt, Unknown
  source: /note="Description of Unknown: Exemplary gene or splice site sequence"
caggucuucc

SEQ ID NO: 1314 - RNA, 10 nt, Unknown
  source: /note="Description of Unknown: Exemplary gene or splice site sequence"
caggucuuuc

SEQ ID NO: 1315 - RNA, 10 nt, Unknown
  source: /note="Description of Unknown: Exemplary gene or splice site sequence"
caggugaaag

SEQ ID NO: 1316 - RNA, 10 nt, Unknown
  source: /note="Description of Unknown: Exemplary gene or splice site sequence"
caggugaaau

SEQ ID NO: 1317 - RNA, 10 nt, Unknown
  source: /note="Description of Unknown: Exemplary gene or splice site sequence"
caggugaaca

SEQ ID NO: 1318 - RNA, 10 nt, Unknown
  source: /note="Description of Unknown: Exemplary gene or splice site sequence"
caggugaaga

SEQ ID NO: 1319 - RNA, 10 nt, Unknown
  source: /note="Description of Unknown: Exemplary gene or splice site sequence"
caggugaagg

SEQ ID NO: 1320 - RNA, 10 nt, Unknown
  source: /note="Description of Unknown: Exemplary gene or splice site sequence"
caggugaaua

SEQ ID NO: 1321 - RNA, 10 nt, Unknown
  source: /note="Description of Unknown: Exemplary gene or splice site sequence"
caggugaauc

SEQ ID NO: 1322 - RNA, 10 nt, Unknown
  source: /note="Description of Unknown: Exemplary gene or splice site sequence"
caggugaauu

SEQ ID NO: 1323 - RNA, 10 nt, Unknown
  source: /note="Description of Unknown: Exemplary gene or splice site sequence"
caggugacaa

SEQ ID NO: 1324 - RNA, 10 nt, Unknown
  source: /note="Description of Unknown: Exemplary gene or splice site sequence"
caggugacau

SEQ ID NO: 1325 - RNA, 10 nt, Unknown
  source: /note="Description of Unknown: Exemplary gene or splice site sequence"
caggugacca

SEQ ID NO: 1326 - RNA, 10 nt, Unknown
  source: /note="Description of Unknown: Exemplary gene or splice site sequence"
caggugaccc

SEQ ID NO: 1327 - RNA, 10 nt, Unknown
  source: /note="Description of Unknown: Exemplary gene or splice site sequence"
caggugaccg

SEQ ID NO: 1328 - RNA, 10 nt, Unknown
  source: /note="Description of Unknown: Exemplary gene or splice site sequence"
caggugaccu

SEQ ID NO: 1329 - RNA, 10 nt, Unknown
  source: /note="Description of Unknown: Exemplary gene or splice site sequence"
caggugacgg

SEQ ID NO: 1330 - RNA, 10 nt, Unknown
  source: /note="Description of Unknown: Exemplary gene or splice site sequence"
caggugacua

SEQ ID NO: 1331 - RNA, 10 nt, Unknown
  source: /note="Description of Unknown: Exemplary gene or splice site sequence"
caggugacuc

SEQ ID NO: 1332 - RNA, 10 nt, Unknown
  source: /note="Description of Unknown: Exemplary gene or splice site sequence"
caggugacug

SEQ ID NO: 1333 - RNA, 10 nt, Unknown
  source: /note="Description of Unknown: Exemplary gene or splice site sequence"
caggugagaa

SEQ ID NO: 1334 - RNA, 10 nt, Unknown
  source: /note="Description of Unknown: Exemplary gene or splice site sequence"
caggugagac

SEQ ID NO: 1335 - RNA, 10 nt, Unknown
  source: /note="Description of Unknown: Exemplary gene or splice site sequence"
caggugagag

SEQ ID NO: 1336 - RNA, 10 nt, Unknown
  source: /note="Description of Unknown: Exemplary gene or splice site sequence"
caggugagau

SEQ ID NO: 1337 - RNA, 10 nt, Unknown
  source: /note="Description of Unknown: Exemplary gene or splice site sequence"
caggugagca

SEQ ID NO: 1338 - RNA, 10 nt, Unknown
  source: /note="Description of Unknown: Exemplary gene or splice site sequence"
caggugagcc

SEQ ID NO: 1339 - RNA, 10 nt, Unknown
  source: /note="Description of Unknown: Exemplary gene or splice site sequence"
caggugagcg

SEQ ID NO: 1340 - RNA, 10 nt, Unknown
  source: /note="Description of Unknown: Exemplary gene or splice site sequence"
caggugagcu

SEQ ID NO: 1341 - RNA, 10 nt, Unknown
  source: /note="Description of Unknown: Exemplary gene or splice site sequence"
caggugagga

SEQ ID NO: 1342 - RNA, 10 nt, Unknown
  source: /note="Description of Unknown: Exemplary gene or splice site sequence"
caggugaggc

SEQ ID NO: 1343 - RNA, 10 nt, Unknown
  source: /note="Description of Unknown: Exemplary gene or splice site sequence"
caggugaggg

SEQ ID NO: 1344 - RNA, 10 nt, Unknown
  source: /note="Description of Unknown: Exemplary gene or splice site sequence"
caggugaggu

SEQ ID NO: 1345 - RNA, 10 nt, Unknown
  source: /note="Description of Unknown: Exemplary gene or splice site sequence"
caggugagua

SEQ ID NO: 1346 - RNA, 10 nt, Unknown
  source: /note="Description of Unknown: Exemplary gene or splice site sequence"
caggugaguc

SEQ ID NO: 1347 - RNA, 10 nt, Unknown
  source: /note="Description of Unknown: Exemplary gene or splice site sequence"
caggugagug

SEQ ID NO: 1348 - RNA, 10 nt, Unknown
  source: /note="Description of Unknown: Exemplary gene or splice site sequence"
caggugaguu

SEQ ID NO: 1349 - RNA, 10 nt, Unknown
  source: /note="Description of Unknown: Exemplary gene or splice site sequence"
caggugauaa

SEQ ID NO: 1350 - RNA, 10 nt, Unknown
  source: /note="Description of Unknown: Exemplary gene or splice site sequence"
caggugaucc

SEQ ID NO: 1351 - RNA, 10 nt, Unknown
  source: /note="Description of Unknown: Exemplary gene or splice site sequence"
caggugaucu

SEQ ID NO: 1352 - RNA, 10 nt, Unknown
  source: /note="Description of Unknown: Exemplary gene or splice site sequence"
caggugaugc

SEQ ID NO: 1353 - RNA, 10 nt, Unknown
  source: /note="Description of Unknown: Exemplary gene or splice site sequence"
caggugaugg

SEQ ID NO: 1354 - RNA, 10 nt, Unknown
  source: /note="Description of Unknown: Exemplary gene or splice site sequence"
caggugaugu

SEQ ID NO: 1355 - RNA, 10 nt, Unknown
  source: /note="Description of Unknown: Exemplary gene or splice site sequence"
caggugauua

SEQ ID NO: 1356 - RNA, 10 nt, Unknown
  source: /note="Description of Unknown: Exemplary gene or splice site sequence"
caggugauuc

SEQ ID NO: 1357 - RNA, 10 nt, Unknown
  source: /note="Description of Unknown: Exemplary gene or splice site sequence"
caggugauug

SEQ ID NO: 1358 - RNA, 10 nt, Unknown
  source: /note="Description of Unknown: Exemplary gene or splice site sequence"
caggugauuu

SEQ ID NO: 1359 - RNA, 10 nt, Unknown
  source: /note="Description of Unknown: Exemplary gene or splice site sequence"
caggugcaaa

SEQ ID NO: 1360 - RNA, 10 nt, Unknown
  source: /note="Description of Unknown: Exemplary gene or splice site sequence"
caggugcaag

SEQ ID NO: 1361 - RNA, 10 nt, Unknown
  source: /note="Description of Unknown: Exemplary gene or splice site sequence"
caggugcaca

SEQ ID NO: 1362 - RNA, 10 nt, Unknown
  source: /note="Description of Unknown: Exemplary gene or splice site sequence"
caggugcacg

SEQ ID NO: 1363 - RNA, 10 nt, Unknown
  source: /note="Description of Unknown: Exemplary gene or splice site sequence"
caggugcaga

SEQ ID NO: 1364 - RNA, 10 nt, Unknown
  source: /note="Description of Unknown: Exemplary gene or splice site sequence"
caggugcagg

SEQ ID NO: 1365 - RNA, 10 nt, Unknown
  source: /note="Description of Unknown: Exemplary gene or splice site sequence"
caggugcaua

SEQ ID NO: 1366 - RNA, 10 nt, Unknown
  source: /note="Description of Unknown: Exemplary gene or splice site sequence"
caggugcauc

SEQ ID NO: 1367 - RNA, 10 nt, Unknown
  source: /note="Description of Unknown: Exemplary gene or splice site sequence"
caggugcaug

SEQ ID NO: 1368 - RNA, 10 nt, Unknown
  source: /note="Description of Unknown: Exemplary gene or splice site sequence"
caggugccaa

SEQ ID NO: 1369 - RNA, 10 nt, Unknown
  source: /note="Description of Unknown: Exemplary gene or splice site sequence"
caggugccca

SEQ ID NO: 1370 - RNA, 10 nt, Unknown
  source: /note="Description of Unknown: Exemplary gene or splice site sequence"
caggugcccc

SEQ ID NO: 1371 - RNA, 10 nt, Unknown
  source: /note="Description of Unknown: Exemplary gene or splice site sequence"
caggugcccg

SEQ ID NO: 1372 - RNA, 10 nt, Unknown
  source: /note="Description of Unknown: Exemplary gene or splice site sequence"
caggugccua

SEQ ID NO: 1373 - RNA, 10 nt, Unknown
  source: /note="Description of Unknown: Exemplary gene or splice site sequence"
caggugccug

SEQ ID NO: 1374 - RNA, 10 nt, Unknown
  source: /note="Description of Unknown: Exemplary gene or splice site sequence"
caggugcgaa

SEQ ID NO: 1375 - RNA, 10 nt, Unknown
  source: /note="Description of Unknown: Exemplary gene or splice site sequence"
caggugcgca

SEQ ID NO: 1376 - RNA, 10 nt, Unknown
  source: /note="Description of Unknown: Exemplary gene or splice site sequence"
caggugcgcc

SEQ ID NO: 1377 - RNA, 10 nt, Unknown
  source: /note="Description of Unknown: Exemplary gene or splice site sequence"
caggugcgcg

SEQ ID NO: 1378 - RNA, 10 nt, Unknown
  source: /note="Description of Unknown: Exemplary gene or splice site sequence"
caggugcgga

SEQ ID NO: 1379 - RNA, 10 nt, Unknown
  source: /note="Description of Unknown: Exemplary gene or splice site sequence"
caggugcggu

SEQ ID NO: 1380 - RNA, 10 nt, Unknown
  source: /note="Description of Unknown: Exemplary gene or splice site sequence"
caggugcgua

SEQ ID NO: 1381 - RNA, 10 nt, Unknown
  source: /note="Description of Unknown: Exemplary gene or splice site sequence"
caggugcguc

SEQ ID NO: 1382 - RNA, 10 nt, Unknown
  source: /note="Description of Unknown: Exemplary gene or splice site sequence"
caggugcgug

SEQ ID NO: 1383 - RNA, 10 nt, Unknown
  source: /note="Description of Unknown: Exemplary gene or splice site sequence"
caggugcuag

SEQ ID NO: 1384 - RNA, 10 nt, Unknown
  source: /note="Description of Unknown: Exemplary gene or splice site sequence"
caggugcuau

SEQ ID NO: 1385 - RNA, 10 nt, Unknown
  source: /note="Description of Unknown: Exemplary gene or splice site sequence"
caggugcuca

SEQ ID NO: 1386 - RNA, 10 nt, Unknown
  source: /note="Description of Unknown: Exemplary gene or splice site sequence"
caggugcucc

SEQ ID NO: 1387 - RNA, 10 nt, Unknown
  source: /note="Description of Unknown: Exemplary gene or splice site sequence"
caggugcucg

SEQ ID NO: 1388 - RNA, 10 nt, Unknown
  source: /note="Description of Unknown: Exemplary gene or splice site sequence"
caggugcugc

SEQ ID NO: 1389 - RNA, 10 nt, Unknown
  source: /note="Description of Unknown: Exemplary gene or splice site sequence"
caggugcugg

SEQ ID NO: 1390 - RNA, 10 nt, Unknown
  source: /note="Description of Unknown: Exemplary gene or splice site sequence"
caggugcuua

SEQ ID NO: 1391 - RNA, 10 nt, Unknown
  source: /note="Description of Unknown: Exemplary gene or splice site sequence"
caggugcuuc

SEQ ID NO: 1392 - RNA, 10 nt, Unknown
  source: /note="Description of Unknown: Exemplary gene or splice site sequence"
caggugcuug

SEQ ID NO: 1393 - RNA, 10 nt, Unknown
  source: /note="Description of Unknown: Exemplary gene or splice site sequence"
cagguggaac

SEQ ID NO: 1394 - RNA, 10 nt, Unknown
  source: /note="Description of Unknown: Exemplary gene or splice site sequence"
cagguggaag

SEQ ID NO: 1395 - RNA, 10 nt, Unknown
  source: /note="Description of Unknown: Exemplary gene or splice site sequence"
cagguggaau

SEQ ID NO: 1396 - RNA, 10 nt, Unknown
  source: /note="Description of Unknown: Exemplary gene or splice site sequence"
cagguggaga

SEQ ID NO: 1397 - RNA, 10 nt, Unknown
  source: /note="Description of Unknown: Exemplary gene or splice site sequence"
cagguggagu

SEQ ID NO: 1398 - RNA, 10 nt, Unknown
  source: /note="Description of Unknown: Exemplary gene or splice site sequence"
cagguggauu

SEQ ID NO: 1399 - RNA, 10 nt, Unknown
  source: /note="Description of Unknown: Exemplary gene or splice site sequence"
cagguggcca

SEQ ID NO: 1400 - RNA, 10 nt, Unknown
  source: /note="Description of Unknown: Exemplary gene or splice site sequence"
cagguggcuc

SEQ ID NO: 1401 - RNA, 10 nt, Unknown
  source: /note="Description of Unknown: Exemplary gene or splice site sequence"
cagguggcug

SEQ ID NO: 1402 - RNA, 10 nt, Unknown
  source: /note="Description of Unknown: Exemplary gene or splice site sequence"
caggugggaa

SEQ ID NO: 1403 - RNA, 10 nt, Unknown
  source: /note="Description of Unknown: Exemplary gene or splice site sequence"
caggugggac

SEQ ID NO: 1404 - RNA, 10 nt, Unknown
  source: /note="Description of Unknown: Exemplary gene or splice site sequence"
caggugggag

SEQ ID NO: 1405 - RNA, 10 nt, Unknown
  source: /note="Description of Unknown: Exemplary gene or splice site sequence"
caggugggau

SEQ ID NO: 1406 - RNA, 10 nt, Unknown
  source: /note="Description of Unknown: Exemplary gene or splice site sequence"
caggugggca

SEQ ID NO: 1407 - RNA, 10 nt, Unknown
  source: /note="Description of Unknown: Exemplary gene or splice site sequence"
caggugggcc

SEQ ID NO: 1408 - RNA, 10 nt, Unknown
  source: /note="Description of Unknown: Exemplary gene or splice site sequence"
caggugggcu

SEQ ID NO: 1409 - RNA, 10 nt, Unknown
  source: /note="Description of Unknown: Exemplary gene or splice site sequence"
caggugggga

SEQ ID NO: 1410 - RNA, 10 nt, Unknown
  source: /note="Description of Unknown: Exemplary gene or splice site sequence"
cagguggggc

SEQ ID NO: 1411 - RNA, 10 nt, Unknown
  source: /note="Description of Unknown: Exemplary gene or splice site sequence"
cagguggggg

SEQ ID NO: 1412 - RNA, 10 nt, Unknown
  source: /note="Description of Unknown: Exemplary gene or splice site sequence"
cagguggggu

SEQ ID NO: 1413 - RNA, 10 nt, Unknown
  source: /note="Description of Unknown: Exemplary gene or splice site sequence"
caggugggua

SEQ ID NO: 1414 - RNA, 10 nt, Unknown
  source: /note="Description of Unknown: Exemplary gene or splice site sequence"
cagguggguc

SEQ ID NO: 1415 - RNA, 10 nt, Unknown
  source: /note="Description of Unknown: Exemplary gene or splice site sequence"
caggugggug

SEQ ID NO: 1416 - RNA, 10 nt, Unknown
  source: /note="Description of Unknown: Exemplary gene or splice site sequence"
cagguggguu

SEQ ID NO: 1417 - RNA, 10 nt, Unknown
  source: /note="Description of Unknown: Exemplary gene or splice site sequence"
cagguggucu

SEQ ID NO: 1418 - RNA, 10 nt, Unknown
  source: /note="Description of Unknown: Exemplary gene or splice site sequence"
cagguggugg

SEQ ID NO: 1419 - RNA, 10 nt, Unknown
  source: /note="Description of Unknown: Exemplary gene or splice site sequence"
caggugguug

SEQ ID NO: 1420 - RNA, 10 nt, Unknown
  source: /note="Description of Unknown: Exemplary gene or splice site sequence"
cagguguaca

SEQ ID NO: 1421 - RNA, 10 nt, Unknown
  source: /note="Description of Unknown: Exemplary gene or splice site sequence"
cagguguagg

SEQ ID NO: 1422 - RNA, 10 nt, Unknown
  source: /note="Description of Unknown: Exemplary gene or splice site sequence"
cagguguauc

SEQ ID NO: 1423 - RNA, 10 nt, Unknown
  source: /note="Description of Unknown: Exemplary gene or splice site sequence"
caggugucac

SEQ ID NO: 1424 - RNA, 10 nt, Unknown
  source: /note="Description of Unknown: Exemplary gene or splice site sequence"
caggugucag

SEQ ID NO: 1425 - RNA, 10 nt, Unknown
  source: /note="Description of Unknown: Exemplary gene or splice site sequence"
caggugucca

SEQ ID NO: 1426 - RNA, 10 nt, Unknown
  source: /note="Description of Unknown: Exemplary gene or splice site sequence"
cagguguccu

SEQ ID NO: 1427 - RNA, 10 nt, Unknown
  source: /note="Description of Unknown: Exemplary gene or splice site sequence"
caggugucua

SEQ ID NO: 1428 - RNA, 10 nt, Unknown
  source: /note="Description of Unknown: Exemplary gene or splice site sequence"
caggugucuc

SEQ ID NO: 1429 - RNA, 10 nt, Unknown
  source: /note="Description of Unknown: Exemplary gene or splice site sequence"
caggugucug

SEQ ID NO: 1430 - RNA, 10 nt, Unknown
  source: /note="Description of Unknown: Exemplary gene or splice site sequence"
caggugugaa

SEQ ID NO: 1431 - RNA, 10 nt, Unknown
  source: /note="Description of Unknown: Exemplary gene or splice site sequence"
caggugugac

SEQ ID NO: 1432 - RNA, 10 nt, Unknown
  source: /note="Description of Unknown: Exemplary gene or splice site sequence"
caggugugag

SEQ ID NO: 1433 - RNA, 10 nt, Unknown
  source: /note="Description of Unknown: Exemplary gene or splice site sequence"
caggugugau

SEQ ID NO: 1434 - RNA, 10 nt, Unknown
  source: /note="Description of Unknown: Exemplary gene or splice site sequence"
caggugugca

SEQ ID NO: 1435 - RNA, 10 nt, Unknown
  source: /note="Description of Unknown: Exemplary gene or splice site sequence"
caggugugcc

SEQ ID NO: 1436 - RNA, 10 nt, Unknown
  source: /note="Description of Unknown: Exemplary gene or splice site sequence"
caggugugcg

SEQ ID NO: 1437 - RNA, 10 nt, Unknown
  source: /note="Description of Unknown: Exemplary gene or splice site sequence"
caggugugcu

SEQ ID NO: 1438 - RNA, 10 nt, Unknown
  source: /note="Description of Unknown: Exemplary gene or splice site sequence"
caggugugga

SEQ ID NO: 1439 - RNA, 10 nt, Unknown
  source: /note="Description of Unknown: Exemplary gene or splice site sequence"
cagguguggc

SEQ ID NO: 1440 - RNA, 10 nt, Unknown
  source: /note="Description of Unknown: Exemplary gene or splice site sequence"
caggugugua

SEQ ID NO: 1441 - RNA, 10 nt, Unknown
  source: /note="Description of Unknown: Exemplary gene or splice site sequence"
cagguguguc

SEQ ID NO: 1442 - RNA, 10 nt, Unknown
  source: /note="Description of Unknown: Exemplary gene or splice site sequence"
caggugugug

SEQ ID NO: 1443 - RNA, 10 nt, Unknown
  source: /note="Description of Unknown: Exemplary gene or splice site sequence"
cagguguguu

SEQ ID NO: 1444 - RNA, 10 nt, Unknown
  source: /note="Description of Unknown: Exemplary gene or splice site sequence"
cagguguuua

SEQ ID NO: 1445 - RNA, 10 nt, Unknown
  source: /note="Description of Unknown: Exemplary gene or splice site sequence"
cagguuaaaa

SEQ ID NO: 1446 - RNA, 10 nt, Unknown
  source: /note="Description of Unknown: Exemplary gene or splice site sequence"
cagguuaaua

SEQ ID NO: 1447 - RNA, 10 nt, Unknown
  source: /note="Description of Unknown: Exemplary gene or splice site sequence"
cagguuaauc

SEQ ID NO: 1448 - RNA, 10 nt, Unknown
  source: /note="Description of Unknown: Exemplary gene or splice site sequence"
cagguuaccu

SEQ ID NO: 1449 - RNA, 10 nt, Unknown
  source: /note="Description of Unknown: Exemplary gene or splice site sequence"
cagguuagaa

SEQ ID NO: 1450 - RNA, 10 nt, Unknown
  source: /note="Description of Unknown: Exemplary gene or splice site sequence"
cagguuagag

SEQ ID NO: 1451 - RNA, 10 nt, Unknown
  source: /note="Description of Unknown: Exemplary gene or splice site sequence"
cagguuagau

SEQ ID NO: 1452 - RNA, 10 nt, Unknown
  source: /note="Description of Unknown: Exemplary gene or splice site sequence"
cagguuagcc

SEQ ID NO: 1453 - RNA, 10 nt, Unknown
  source: /note="Description of Unknown: Exemplary gene or splice site sequence"
cagguuaggg

SEQ ID NO: 1454 - RNA, 10 nt, Unknown
  source: /note="Description of Unknown: Exemplary gene or splice site sequence"
cagguuaggu

SEQ ID NO: 1455 - RNA, 10 nt, Unknown
  source: /note="Description of Unknown: Exemplary gene or splice site sequence"
cagguuagua

SEQ ID NO: 1456 - RNA, 10 nt, Unknown
  source: /note="Description of Unknown: Exemplary gene or splice site sequence"
cagguuaguc

SEQ ID NO: 1457 - RNA, 10 nt, Unknown
  source: /note="Description of Unknown: Exemplary gene or splice site sequence"
cagguuagug

SEQ ID NO: 1458 - RNA, 10 nt, Unknown
  source: /note="Description of Unknown: Exemplary gene or splice site sequence"
cagguuaguu

SEQ ID NO: 1459 - RNA, 10 nt, Unknown
  source: /note="Description of Unknown: Exemplary gene or splice site sequence"
cagguuauca

SEQ ID NO: 1460 - RNA, 10 nt, Unknown
  source: /note="Description of Unknown: Exemplary gene or splice site sequence"
cagguuaugu

SEQ ID NO: 1461 - RNA, 10 nt, Unknown
  source: /note="Description of Unknown: Exemplary gene or splice site sequence"
cagguuauua

SEQ ID NO: 1462 - RNA, 10 nt, Unknown
  source: /note="Description of Unknown: Exemplary gene or splice site sequence"
cagguuauug

SEQ ID NO: 1463 - RNA, 10 nt, Unknown
  source: /note="Description of Unknown: Exemplary gene or splice site sequence"
cagguucaaa

SEQ ID NO: 1464 - RNA, 10 nt, Unknown
  source: /note="Description of Unknown: Exemplary gene or splice site sequence"
cagguucaac

SEQ ID NO: 1465 - RNA, 10 nt, Unknown
  source: /note="Description of Unknown: Exemplary gene or splice site sequence"
cagguucaag

SEQ ID NO: 1466 - RNA, 10 nt, Unknown
  source: /note="Description of Unknown: Exemplary gene or splice site sequence"
cagguucaca

SEQ ID NO: 1467 - RNA, 10 nt, Unknown
  source: /note="Description of Unknown: Exemplary gene or splice site sequence"
cagguucacg

SEQ ID NO: 1468 - RNA, 10 nt, Unknown
  source: /note="Description of Unknown: Exemplary gene or splice site sequence"
cagguucagg

SEQ ID NO: 1469 - RNA, 10 nt, Unknown
  source: /note="Description of Unknown: Exemplary gene or splice site sequence"
cagguucaug

SEQ ID NO: 1470 - RNA, 10 nt, Unknown
  source: /note="Description of Unknown: Exemplary gene or splice site sequence"
cagguuccag

SEQ ID NO: 1471 - RNA, 10 nt, Unknown
  source: /note="Description of Unknown: Exemplary gene or splice site sequence"
cagguuccca

SEQ ID NO: 1472 - RNA, 10 nt, Unknown
  source: /note="Description of Unknown: Exemplary gene or splice site sequence"
cagguucccg

SEQ ID NO: 1473 - RNA, 10 nt, Unknown
  source: /note="Description of Unknown: Exemplary gene or splice site sequence"
cagguucgaa

SEQ ID NO: 1474 - RNA, 10 nt, Unknown
  source: /note="Description of Unknown: Exemplary gene or splice site sequence"
cagguucgag

SEQ ID NO: 1475 - RNA, 10 nt, Unknown
  source: /note="Description of Unknown: Exemplary gene or splice site sequence"
cagguucuau

SEQ ID NO: 1476 - RNA, 10 nt, Unknown
  source: /note="Description of Unknown: Exemplary gene or splice site sequence"
cagguucugc

SEQ ID NO: 1477 - RNA, 10 nt, Unknown
  source: /note="Description of Unknown: Exemplary gene or splice site sequence"
cagguucuua

SEQ ID NO: 1478 - RNA, 10 nt, Unknown
  source: /note="Description of Unknown: Exemplary gene or splice site sequence"
cagguucuuc

SEQ ID NO: 1479 - RNA, 10 nt, Unknown
  source: /note="Description of Unknown: Exemplary gene or splice site sequence"
cagguucuuu

SEQ ID NO: 1480 - RNA, 10 nt, Unknown
  source: /note="Description of Unknown: Exemplary gene or splice site sequence"
cagguugaac

SEQ ID NO: 1481 - RNA, 10 nt, Unknown
  source: /note="Description of Unknown: Exemplary gene or splice site sequence"
cagguugaag

SEQ ID NO: 1482 - RNA, 10 nt, Unknown
  source: /note="Description of Unknown: Exemplary gene or splice site sequence"
cagguugagu

SEQ ID NO: 1483 - RNA, 10 nt, Unknown
  source: /note="Description of Unknown: Exemplary gene or splice site sequence"
cagguugaua

SEQ ID NO: 1484 - RNA, 10 nt, Unknown
  source: /note="Description of Unknown: Exemplary gene or splice site sequence"
cagguuggag

SEQ ID NO: 1485 - RNA, 10 nt, Unknown
  source: /note="Description of Unknown: Exemplary gene or splice site sequence"
cagguuggca

SEQ ID NO: 1486 - RNA, 10 nt, Unknown
  source: /note="Description of Unknown: Exemplary gene or splice site sequence"
cagguuggcc

SEQ ID NO: 1487 - RNA, 10 nt, Unknown
  source: /note="Description of Unknown: Exemplary gene or splice site sequence"
cagguugguc

SEQ ID NO: 1488 - RNA, 10 nt, Unknown
  source: /note="Description of Unknown: Exemplary gene or splice site sequence"
cagguuggug

SEQ ID NO: 1489 - RNA, 10 nt, Unknown
  source: /note="Description of Unknown: Exemplary gene or splice site sequence"
cagguugguu

SEQ ID NO: 1490 - RNA, 10 nt, Unknown
  source: /note="Description of Unknown: Exemplary gene or splice site sequence"
cagguuguaa

SEQ ID NO: 1491 - RNA, 10 nt, Unknown
  source: /note="Description of Unknown: Exemplary gene or splice site sequence"
cagguuguac

SEQ ID NO: 1492 - RNA, 10 nt, Unknown
  source: /note="Description of Unknown: Exemplary gene or splice site sequence"
cagguuguau

SEQ ID NO: 1493 - RNA, 10 nt, Unknown
  source: /note="Description of Unknown: Exemplary gene or splice site sequence"
cagguuguca

SEQ ID NO: 1494 - RNA, 10 nt, Unknown
  source: /note="Description of Unknown: Exemplary gene or splice site sequence"
cagguuguga

SEQ ID NO: 1495 - RNA, 10 nt, Unknown
  source: /note="Description of Unknown: Exemplary gene or splice site sequence"
cagguuguug

SEQ ID NO: 1496 - RNA, 10 nt, Unknown
  source: /note="Description of Unknown: Exemplary gene or splice site sequence"
cagguuuaag

SEQ ID NO: 1497 - RNA, 10 nt, Unknown
  source: /note="Description of Unknown: Exemplary gene or splice site sequence"
cagguuuacc

SEQ ID NO: 1498 - RNA, 10 nt, Unknown
  source: /note="Description of Unknown: Exemplary gene or splice site sequence"
cagguuuagc

SEQ ID NO: 1499 - RNA, 10 nt, Unknown
  source: /note="Description of Unknown: Exemplary gene or splice site sequence"
cagguuuagu

SEQ ID NO: 1500 - RNA, 10 nt, Unknown
  source: /note="Description of Unknown: Exemplary gene or splice site sequence"
cagguuucuu

SEQ ID NO: 1501 - RNA, 10 nt, Unknown
  source: /note="Description of Unknown: Exemplary gene or splice site sequence"
cagguuugaa

SEQ ID NO: 1502 - RNA, 10 nt, Unknown
  source: /note="Description of Unknown: Exemplary gene or splice site sequence"
cagguuugag

SEQ ID NO: 1503 - RNA, 10 nt, Unknown
  source: /note="Description of Unknown: Exemplary gene or splice site sequence"
cagguuugau

SEQ ID NO: 1504 - RNA, 10 nt, Unknown
  source: /note="Description of Unknown: Exemplary gene or splice site sequence"
cagguuugcc

SEQ ID NO: 1505 - RNA, 10 nt, Unknown
  source: /note="Description of Unknown: Exemplary gene or splice site sequence"
cagguuugcu

SEQ ID NO: 1506 - RNA, 10 nt, Unknown
  source: /note="Description of Unknown: Exemplary gene or splice site sequence"
cagguuuggg

SEQ ID NO: 1507 - RNA, 10 nt, Unknown
  source: /note="Description of Unknown: Exemplary gene or splice site sequence"
cagguuuggu

SEQ ID NO: 1508 - RNA, 10 nt, Unknown
  source: /note="Description of Unknown: Exemplary gene or splice site sequence"
cagguuugua

SEQ ID NO: 1509 - RNA, 10 nt, Unknown
  source: /note="Description of Unknown: Exemplary gene or splice site sequence"
cagguuugug

SEQ ID NO: 1510 - RNA, 10 nt, Unknown
  source: /note="Description of Unknown: Exemplary gene or splice site sequence"
cagguuuguu

SEQ ID NO: 1511 - RNA, 10 nt, Unknown
  source: /note="Description of Unknown: Exemplary gene or splice site sequence"
cagguuuucu

SEQ ID NO: 1512 - RNA, 10 nt, Unknown
  source: /note="Description of Unknown: Exemplary gene or splice site sequence"
cagguuuugg

SEQ ID NO: 1513 - RNA, 10 nt, Unknown
  source: /note="Description of Unknown: Exemplary gene or splice site sequence"
cagguuuuuc

SEQ ID NO: 1514 - RNA, 10 nt, Unknown
  source: /note="Description of Unknown: Exemplary gene or splice site sequence"
cagguuuuuu

SEQ ID NO: 1515 - RNA, 10 nt, Unknown
  source: /note="Description of Unknown: Exemplary gene or splice site sequence"
caugcagguu

SEQ ID NO: 1516 - RNA, 10 nt, Unknown
  source: /note="Description of Unknown: Exemplary gene or splice site sequence"
cauguaaaac

SEQ ID NO: 1517 - RNA, 10 nt, Unknown
  source: /note="Description of Unknown: Exemplary gene or splice site sequence"
cauguaacua

SEQ ID NO: 1518 - RNA, 10 nt, Unknown
  source: /note="Description of Unknown: Exemplary gene or splice site sequence"
cauguaagaa

SEQ ID NO: 1519 - RNA, 10 nt, Unknown
  source: /note="Description of Unknown: Exemplary gene or splice site sequence"
cauguaagag

SEQ ID NO: 1520 - RNA, 10 nt, Unknown
  source: /note="Description of Unknown: Exemplary gene or splice site sequence"
cauguaagau

SEQ ID NO: 1521 - RNA, 10 nt, Unknown
  source: /note="Description of Unknown: Exemplary gene or splice site sequence"
cauguaagcc

SEQ ID NO: 1522 - RNA, 10 nt, Unknown
  source: /note="Description of Unknown: Exemplary gene or splice site sequence"
cauguaagua

SEQ ID NO: 1523 - RNA, 10 nt, Unknown
  source: /note="Description of Unknown: Exemplary gene or splice site sequence"
cauguaagug

SEQ ID NO: 1524 - RNA, 10 nt, Unknown
  source: /note="Description of Unknown: Exemplary gene or splice site sequence"
cauguaaguu

SEQ ID NO: 1525 - RNA, 10 nt, Unknown
  source: /note="Description of Unknown: Exemplary gene or splice site sequence"
cauguaauua

SEQ ID NO: 1526 - RNA, 10 nt, Unknown
  source: /note="Description of Unknown: Exemplary gene or splice site sequence"
cauguacaua

SEQ ID NO: 1527 - RNA, 10 nt, Unknown
  source: /note="Description of Unknown: Exemplary gene or splice site sequence"
cauguaccac

SEQ ID NO: 1528 - RNA, 10 nt, Unknown
  source: /note="Description of Unknown: Exemplary gene or splice site sequence"
cauguacguu

SEQ ID NO: 1529 - RNA, 10 nt, Unknown
  source: /note="Description of Unknown: Exemplary gene or splice site sequence"
cauguaggua

SEQ ID NO: 1530 - RNA, 10 nt, Unknown
  source: /note="Description of Unknown: Exemplary gene or splice site sequence"
cauguaggug

SEQ ID NO: 1531 - RNA, 10 nt, Unknown
  source: /note="Description of Unknown: Exemplary gene or splice site sequence"
cauguagguu

SEQ ID NO: 1532 - RNA, 10 nt, Unknown
  source: /note="Description of Unknown: Exemplary gene or splice site sequence"
cauguaugaa

SEQ ID NO: 1533 - RNA, 10 nt, Unknown
  source: /note="Description of Unknown: Exemplary gene or splice site sequence"
cauguaugua

SEQ ID NO: 1534 - RNA, 10 nt, Unknown
  source: /note="Description of Unknown: Exemplary gene or splice site sequence"
cauguaugug

SEQ ID NO: 1535 - RNA, 10 nt, Unknown
  source: /note="Description of Unknown: Exemplary gene or splice site sequence"
cauguauguu

SEQ ID NO: 1536 - RNA, 10 nt, Unknown
  source: /note="Description of Unknown: Exemplary gene or splice site sequence"
caugugagaa

SEQ ID NO: 1537 - RNA, 10 nt, Unknown
  source: /note="Description of Unknown: Exemplary gene or splice site sequence"
caugugagca

SEQ ID NO: 1538 - RNA, 10 nt, Unknown
  source: /note="Description of Unknown: Exemplary gene or splice site sequence"
caugugagcu

SEQ ID NO: 1539 - RNA, 10 nt, Unknown
  source: /note="Description of Unknown: Exemplary gene or splice site sequence"
caugugagua

SEQ ID NO: 1540 - RNA, 10 nt, Unknown
  source: /note="Description of Unknown: Exemplary gene or splice site sequence"
caugugaguc

SEQ ID NO: 1541 - RNA, 10 nt, Unknown
  source: /note="Description of Unknown: Exemplary gene or splice site sequence"
caugugagug

SEQ ID NO: 1542 - RNA, 10 nt, Unknown
  source: /note="Description of Unknown: Exemplary gene or splice site sequence"
caugugaguu

SEQ ID NO: 1543 - RNA, 10 nt, Unknown
  source: /note="Description of Unknown: Exemplary gene or splice site sequence"
caugugcgua

SEQ ID NO: 1544 - RNA, 10 nt, Unknown
  source: /note="Description of Unknown: Exemplary gene or splice site sequence"
caugugggaa

SEQ ID NO: 1545 - RNA, 10 nt, Unknown
  source: /note="Description of Unknown: Exemplary gene or splice site sequence"
cauguggguu

SEQ ID NO: 1546 - RNA, 10 nt, Unknown
  source: /note="Description of Unknown: Exemplary gene or splice site sequence"
caugugugug

SEQ ID NO: 1547 - RNA, 10 nt, Unknown
  source: /note="Description of Unknown: Exemplary gene or splice site sequence"
cauguguguu

SEQ ID NO: 1548 - RNA, 10 nt, Unknown
  source: /note="Description of Unknown: Exemplary gene or splice site sequence"
cauguuaaua

SEQ ID NO: 1549 - RNA, 10 nt, Unknown
  source: /note="Description of Unknown: Exemplary gene or splice site sequence"
cauguuagcc

SEQ ID NO: 1550 - RNA, 10 nt, Unknown
  source: /note="Description of Unknown: Exemplary gene or splice site sequence"
ccaguaagau

SEQ ID NO: 1551 - RNA, 10 nt, Unknown
  source: /note="Description of Unknown: Exemplary gene or splice site sequence"
ccaguaagca

SEQ ID NO: 1552 - RNA, 10 nt, Unknown
  source: /note="Description of Unknown: Exemplary gene or splice site sequence"
ccaguaagcc

SEQ ID NO: 1553 - RNA, 10 nt, Unknown
  source: /note="Description of Unknown: Exemplary gene or splice site sequence"
ccaguaagcu

SEQ ID NO: 1554 - RNA, 10 nt, Unknown
  source: /note="Description of Unknown: Exemplary gene or splice site sequence"
ccaguaagga

SEQ ID NO: 1555 - RNA, 10 nt, Unknown
  source: /note="Description of Unknown: Exemplary gene or splice site sequence"
ccaguaagua

SEQ ID NO: 1556 - RNA, 10 nt, Unknown
  source: /note="Description of Unknown: Exemplary gene or splice site sequence"
ccaguaaguc

SEQ ID NO: 1557 - RNA, 10 nt, Unknown
  source: /note="Description of Unknown: Exemplary gene or splice site sequence"
ccaguaagug

SEQ ID NO: 1558 - RNA, 10 nt, Unknown
  source: /note="Description of Unknown: Exemplary gene or splice site sequence"
ccaguaaguu

SEQ ID NO: 1559 - RNA, 10 nt, Unknown
  source: /note="Description of Unknown: Exemplary gene or splice site sequence"
ccaguaauug

SEQ ID NO: 1560 - RNA, 10 nt, Unknown
  source: /note="Description of Unknown: Exemplary gene or splice site sequence"
ccaguacggg

SEQ ID NO: 1561 - RNA, 10 nt, Unknown
  source: /note="Description of Unknown: Exemplary gene or splice site sequence"
ccaguagguc

SEQ ID NO: 1562 - RNA, 10 nt, Unknown
  source: /note="Description of Unknown: Exemplary gene or splice site sequence"
ccaguauugu

SEQ ID NO: 1563 - RNA, 10 nt, Unknown
  source: /note="Description of Unknown: Exemplary gene or splice site sequence"
ccagugaggc

SEQ ID NO: 1564 - RNA, 10 nt, Unknown
  source: /note="Description of Unknown: Exemplary gene or splice site sequence"
ccagugagua

SEQ ID NO: 1565 - RNA, 10 nt, Unknown
  source: /note="Description of Unknown: Exemplary gene or splice site sequence"
ccagugagug

SEQ ID NO: 1566 - RNA, 10 nt, Unknown
  source: /note="Description of Unknown: Exemplary gene or splice site sequence"
ccaguggguc

SEQ ID NO: 1567 - RNA, 10 nt, Unknown
  source: /note="Description of Unknown: Exemplary gene or splice site sequence"
ccaguuaguu

SEQ ID NO: 1568 - RNA, 10 nt, Unknown
  source: /note="Description of Unknown: Exemplary gene or splice site sequence"
ccaguugagu

SEQ ID NO: 1569 - RNA, 10 nt, Unknown
  source: /note="Description of Unknown: Exemplary gene or splice site sequence"
cccguaagau

SEQ ID NO: 1570 - RNA, 10 nt, Unknown
  source: /note="Description of Unknown: Exemplary gene or splice site sequence"
cccguauguc

SEQ ID NO: 1571 - RNA, 10 nt, Unknown
  source: /note="Description of Unknown: Exemplary gene or splice site sequence"
cccguauguu

SEQ ID NO: 1572 - RNA, 10 nt, Unknown
  source: /note="Description of Unknown: Exemplary gene or splice site sequence"
cccguccugc

SEQ ID NO: 1573 - RNA, 10 nt, Unknown
  source: /note="Description of Unknown: Exemplary gene or splice site sequence"
cccgugagug

SEQ ID NO: 1574 - RNA, 10 nt, Unknown
  source: /note="Description of Unknown: Exemplary gene or splice site sequence"
ccgguaaaga

SEQ ID NO: 1575 - RNA, 10 nt, Unknown
  source: /note="Description of Unknown: Exemplary gene or splice site sequence"
ccgguaagau

SEQ ID NO: 1576 - RNA, 10 nt, Unknown
  source: /note="Description of Unknown: Exemplary gene or splice site sequence"
ccgguaagcc

SEQ ID NO: 1577 - RNA, 10 nt, Unknown
  source: /note="Description of Unknown: Exemplary gene or splice site sequence"
ccgguaagga

SEQ ID NO: 1578 - RNA, 10 nt, Unknown
  source: /note="Description of Unknown: Exemplary gene or splice site sequence"
ccgguaaggc

SEQ ID NO: 1579 - RNA, 10 nt, Unknown
  source: /note="Description of Unknown: Exemplary gene or splice site sequence"
ccgguaaugg

SEQ ID NO: 1580 - RNA, 10 nt, Unknown
  source: /note="Description of Unknown: Exemplary gene or splice site sequence"
ccgguacagu

SEQ ID NO: 1581 - RNA, 10 nt, Unknown
  source: /note="Description of Unknown: Exemplary gene or splice site sequence"
ccgguacuga

SEQ ID NO: 1582 - RNA, 10 nt, Unknown
  source: /note="Description of Unknown: Exemplary gene or splice site sequence"
ccgguauucc

SEQ ID NO: 1583 - RNA, 10 nt, Unknown
  source: /note="Description of Unknown: Exemplary gene or splice site sequence"
ccggucagug

SEQ ID NO: 1584 - RNA, 10 nt, Unknown
  source: /note="Description of Unknown: Exemplary gene or splice site sequence"
ccggugaaaa

SEQ ID NO: 1585 - RNA, 10 nt, Unknown
  source: /note="Description of Unknown: Exemplary gene or splice site sequence"
ccggugagaa

SEQ ID NO: 1586 - RNA, 10 nt, Unknown
  source: /note="Description of Unknown: Exemplary gene or splice site sequence"
ccggugaggg

SEQ ID NO: 1587 - RNA, 10 nt, Unknown
  source: /note="Description of Unknown: Exemplary gene or splice site sequence"
ccggugagug

SEQ ID NO: 1588 - RNA, 10 nt, Unknown
  source: /note="Description of Unknown: Exemplary gene or splice site sequence"
ccggugaguu

SEQ ID NO: 1589 - RNA, 10 nt, Unknown
  source: /note="Description of Unknown: Exemplary gene or splice site sequence"
ccggugcgcg

SEQ ID NO: 1590 - RNA, 10 nt, Unknown
  source: /note="Description of Unknown: Exemplary gene or splice site sequence"
ccggugggcg

SEQ ID NO: 1591 - RNA, 10 nt, Unknown
  source: /note="Description of Unknown: Exemplary gene or splice site sequence"
ccgguugguc

SEQ ID NO: 1592 - RNA, 10 nt, Unknown
  source: /note="Description of Unknown: Exemplary gene or splice site sequence"
ccuguaaaug

SEQ ID NO: 1593 - RNA, 10 nt, Unknown
  source: /note="Description of Unknown: Exemplary gene or splice site sequence"
ccuguaaauu

SEQ ID NO: 1594 - RNA, 10 nt, Unknown
  source: /note="Description of Unknown: Exemplary gene or splice site sequence"
ccuguaagaa

SEQ ID NO: 1595 - RNA, 10 nt, Unknown
  source: /note="Description of Unknown: Exemplary gene or splice site sequence"
ccuguaagac

SEQ ID NO: 1596 - RNA, 10 nt, Unknown
  source: /note="Description of Unknown: Exemplary gene or splice site sequence"
ccuguaagag

SEQ ID NO: 1597 - RNA, 10 nt, Unknown
  source: /note="Description of Unknown: Exemplary gene or splice site sequence"
ccuguaagca

SEQ ID NO: 1598 - RNA, 10 nt, Unknown
  source: /note="Description of Unknown: Exemplary gene or splice site sequence"
ccuguaagcg

SEQ ID NO: 1599 - RNA, 10 nt, Unknown
  source: /note="Description of Unknown: Exemplary gene or splice site sequence"
ccuguaagga

SEQ ID NO: 1600 - RNA, 10 nt, Unknown
  source: /note="Description of Unknown: Exemplary gene or splice site sequence"
ccuguaaguu

SEQ ID NO: 1601 - RNA, 10 nt, Unknown
  source: /note="Description of Unknown: Exemplary gene or splice site sequence"
ccuguaggua

SEQ ID NO: 1602 - RNA, 10 nt, Unknown
  source: /note="Description of Unknown: Exemplary gene or splice site sequence"
ccuguaggug

SEQ ID NO: 1603 - RNA, 10 nt, Unknown
  source: /note="Description of Unknown: Exemplary gene or splice site sequence"
ccuguaucuu

SEQ ID NO: 1604 - RNA, 10 nt, Unknown
  source: /note="Description of Unknown: Exemplary gene or splice site sequence"
ccuguauggu

SEQ ID NO: 1605 - RNA, 10 nt, Unknown
  source: /note="Description of Unknown: Exemplary gene or splice site sequence"
ccuguaugug

SEQ ID NO: 1606 - RNA, 10 nt, Unknown
  source: /note="Description of Unknown: Exemplary gene or splice site sequence"
ccugugagaa

SEQ ID NO: 1607 - RNA, 10 nt, Unknown
  source: /note="Description of Unknown: Exemplary gene or splice site sequence"
ccugugagca

SEQ ID NO: 1608 - RNA, 10 nt, Unknown
  source: /note="Description of Unknown: Exemplary gene or splice site sequence"
ccugugaggg

SEQ ID NO: 1609 - RNA, 10 nt, Unknown
  source: /note="Description of Unknown: Exemplary gene or splice site sequence"
ccugugaguc

SEQ ID NO: 1610 - RNA, 10 nt, Unknown
  source: /note="Description of Unknown: Exemplary gene or splice site sequence"
ccugugagug

SEQ ID NO: 1611 - RNA, 10 nt, Unknown
  source: /note="Description of Unknown: Exemplary gene or splice site sequence"
ccugugaguu

SEQ ID NO: 1612 - RNA, 10 nt, Unknown
  source: /note="Description of Unknown: Exemplary gene or splice site sequence"
ccuguggcuc

SEQ ID NO: 1613 - RNA, 10 nt, Unknown
  source: /note="Description of Unknown: Exemplary gene or splice site sequence"
ccugugggua

SEQ ID NO: 1614 - RNA, 10 nt, Unknown
  source: /note="Description of Unknown: Exemplary gene or splice site sequence"
ccugugugua

SEQ ID NO: 1615 - RNA, 10 nt, Unknown
  source: /note="Description of Unknown: Exemplary gene or splice site sequence"
ccuguuagaa

SEQ ID NO: 1616 - RNA, 10 nt, Unknown
  source: /note="Description of Unknown: Exemplary gene or splice site sequence"
cgaguaaggg

SEQ ID NO: 1617 - RNA, 10 nt, Unknown
  source: /note="Description of Unknown: Exemplary gene or splice site sequence"
cgaguaaggu

SEQ ID NO: 1618 - RNA, 10 nt, Unknown
  source: /note="Description of Unknown: Exemplary gene or splice site sequence"
cgaguagcug

SEQ ID NO: 1619 - RNA, 10 nt, Unknown
  source: /note="Description of Unknown: Exemplary gene or splice site sequence"
cgaguaggug

SEQ ID NO: 1620 - RNA, 10 nt, Unknown
  source: /note="Description of Unknown: Exemplary gene or splice site sequence"
cgaguagguu

SEQ ID NO: 1621 - RNA, 10 nt, Unknown
  source: /note="Description of Unknown: Exemplary gene or splice site sequence"
cgagugagca

SEQ ID NO: 1622 - RNA, 10 nt, Unknown
  source: /note="Description of Unknown: Exemplary gene or splice site sequence"
cgcguaagag

SEQ ID NO: 1623 - RNA, 10 nt, Unknown
  source: /note="Description of Unknown: Exemplary gene or splice site sequence"
cgggcaggca

SEQ ID NO: 1624 - RNA, 10 nt, Unknown
  source: /note="Description of Unknown: Exemplary gene or splice site sequence"
cggguaagcc

SEQ ID NO: 1625 - RNA, 10 nt, Unknown
  source: /note="Description of Unknown: Exemplary gene or splice site sequence"
cggguaagcu

SEQ ID NO: 1626 - RNA, 10 nt, Unknown
  source: /note="Description of Unknown: Exemplary gene or splice site sequence"
cggguaaguu

SEQ ID NO: 1627 - RNA, 10 nt, Unknown
  source: /note="Description of Unknown: Exemplary gene or splice site sequence"
cggguaauuc

SEQ ID NO: 1628 - RNA, 10 nt, Unknown
  source: /note="Description of Unknown: Exemplary gene or splice site sequence"
cggguaauuu

SEQ ID NO: 1629 - RNA, 10 nt, Unknown
  source: /note="Description of Unknown: Exemplary gene or splice site sequence"
cggguacagu

SEQ ID NO: 1630 - RNA, 10 nt, Unknown
  source: /note="Description of Unknown: Exemplary gene or splice site sequence"
cggguacggg

SEQ ID NO: 1631 - RNA, 10 nt, Unknown
  source: /note="Description of Unknown: Exemplary gene or splice site sequence"
cggguaggag

SEQ ID NO: 1632 - RNA, 10 nt, Unknown
  source: /note="Description of Unknown: Exemplary gene or splice site sequence"
cggguaggcc

SEQ ID NO: 1633 - RNA, 10 nt, Unknown
  source: /note="Description of Unknown: Exemplary gene or splice site sequence"
cggguaggug

SEQ ID NO: 1634 - RNA, 10 nt, Unknown
  source: /note="Description of Unknown: Exemplary gene or splice site sequence"
cggguauuua

SEQ ID NO: 1635 - RNA, 10 nt, Unknown
  source: /note="Description of Unknown: Exemplary gene or splice site sequence"
cgggucugag

SEQ ID NO: 1636 - RNA, 10 nt, Unknown
  source: /note="Description of Unknown: Exemplary gene or splice site sequence"
cgggugaccg

SEQ ID NO: 1637 - RNA, 10 nt, Unknown
  source: /note="Description of Unknown: Exemplary gene or splice site sequence"
cgggugacuc

SEQ ID NO: 1638 - RNA, 10 nt, Unknown
  source: /note="Description of Unknown: Exemplary gene or splice site sequence"
cgggugagaa

SEQ ID NO: 1639 - RNA, 10 nt, Unknown
  source: /note="Description of Unknown: Exemplary gene or splice site sequence"
cgggugaggg

SEQ ID NO: 1640 - RNA, 10 nt, Unknown
  source: /note="Description of Unknown: Exemplary gene or splice site sequence"
cgggugaggu

SEQ ID NO: 1641 - RNA, 10 nt, Unknown
  source: /note="Description of Unknown: Exemplary gene or splice site sequence"
cgggugagua

SEQ ID NO: 1642 - RNA, 10 nt, Unknown
  source: /note="Description of Unknown: Exemplary gene or splice site sequence"
cgggugagug

SEQ ID NO: 1643 - RNA, 10 nt, Unknown
  source: /note="Description of Unknown: Exemplary gene or splice site sequence"
cgggugaguu

SEQ ID NO: 1644 - RNA, 10 nt, Unknown
  source: /note="Description of Unknown: Exemplary gene or splice site sequence"
cgggugauuu

SEQ ID NO: 1645 - RNA, 10 nt, Unknown
  source: /note="Description of Unknown: Exemplary gene or splice site sequence"
cgggugccuu

SEQ ID NO: 1646 - RNA, 10 nt, Unknown
  source: /note="Description of Unknown: Exemplary gene or splice site sequence"
cgggugggag

SEQ ID NO: 1647 - RNA, 10 nt, Unknown
  source: /note="Description of Unknown: Exemplary gene or splice site sequence"
cgggugggug

SEQ ID NO: 1648 - RNA, 10 nt, Unknown
  source: /note="Description of Unknown: Exemplary gene or splice site sequence"
cggguggguu

SEQ ID NO: 1649 - RNA, 10 nt, Unknown
  source: /note="Description of Unknown: Exemplary gene or splice site sequence"
cggguguguc

SEQ ID NO: 1650 - RNA, 10 nt, Unknown
  source: /note="Description of Unknown: Exemplary gene or splice site sequence"
cgggugugug

SEQ ID NO: 1651 - RNA, 10 nt, Unknown
  source: /note="Description of Unknown: Exemplary gene or splice site sequence"
cggguguguu

SEQ ID NO: 1652 - RNA, 10 nt, Unknown
  source: /note="Description of Unknown: Exemplary gene or splice site sequence"
cggguucaag

SEQ ID NO: 1653 - RNA, 10 nt, Unknown
  source: /note="Description of Unknown: Exemplary gene or splice site sequence"
cggguucaug

SEQ ID NO: 1654 - RNA, 10 nt, Unknown
  source: /note="Description of Unknown: Exemplary gene or splice site sequence"
cggguuugcu

SEQ ID NO: 1655 - RNA, 10 nt, Unknown
  source: /note="Description of Unknown: Exemplary gene or splice site sequence"
cguguagggu

SEQ ID NO: 1656 - RNA, 10 nt, Unknown
  source: /note="Description of Unknown: Exemplary gene or splice site sequence"
cguguaugca

SEQ ID NO: 1657 - RNA, 10 nt, Unknown
  source: /note="Description of Unknown: Exemplary gene or splice site sequence"
cguguaugua

SEQ ID NO: 1658 - RNA, 10 nt, Unknown
  source: /note="Description of Unknown: Exemplary gene or splice site sequence"
cgugucugua

SEQ ID NO: 1659 - RNA, 10 nt, Unknown
  source: /note="Description of Unknown: Exemplary gene or splice site sequence"
cgugugagug

SEQ ID NO: 1660 - RNA, 10 nt, Unknown
  source: /note="Description of Unknown: Exemplary gene or splice site sequence"
cguguuuucu

SEQ ID NO: 1661 - RNA, 10 nt, Unknown
  source: /note="Description of Unknown: Exemplary gene or splice site sequence"
cuaguaaaug

SEQ ID NO: 1662 - RNA, 10 nt, Unknown
  source: /note="Description of Unknown: Exemplary gene or splice site sequence"
cuaguaagcg

SEQ ID NO: 1663 - RNA, 10 nt, Unknown
  source: /note="Description of Unknown: Exemplary gene or splice site sequence"
cuaguaagcu

SEQ ID NO: 1664 - RNA, 10 nt, Unknown
  source: /note="Description of Unknown: Exemplary gene or splice site sequence"
cuaguaagua

SEQ ID NO: 1665 - RNA, 10 nt, Unknown
  source: /note="Description of Unknown: Exemplary gene or splice site sequence"
cuaguaaguc

SEQ ID NO: 1666 - RNA, 10 nt, Unknown
  source: /note="Description of Unknown: Exemplary gene or splice site sequence"
cuaguaagug

SEQ ID NO: 1667 - RNA, 10 nt, Unknown
  source: /note="Description of Unknown: Exemplary gene or splice site sequence"
cuaguaaguu

SEQ ID NO: 1668 - RNA, 10 nt, Unknown
  source: /note="Description of Unknown: Exemplary gene or splice site sequence"
cuaguaauuu

SEQ ID NO: 1669 - RNA, 10 nt, Unknown
  source: /note="Description of Unknown: Exemplary gene or splice site sequence"
cuaguaggua

SEQ ID NO: 1670 - RNA, 10 nt, Unknown
  source: /note="Description of Unknown: Exemplary gene or splice site sequence"
cuaguagguu

SEQ ID NO: 1671 - RNA, 10 nt, Unknown
  source: /note="Description of Unknown: Exemplary gene or splice site sequence"
cuaguaugua

SEQ ID NO: 1672 - RNA, 10 nt, Unknown
  source: /note="Description of Unknown: Exemplary gene or splice site sequence"
cuaguauguu

SEQ ID NO: 1673 - RNA, 10 nt, Unknown
  source: /note="Description of Unknown: Exemplary gene or splice site sequence"
cuagugagua

SEQ ID NO: 1674 - RNA, 10 nt, Unknown
  source: /note="Description of Unknown: Exemplary gene or splice site sequence"
cucguaagca

SEQ ID NO: 1675 - RNA, 10 nt, Unknown
  source: /note="Description of Unknown: Exemplary gene or splice site sequence"
cucguaagug

SEQ ID NO: 1676 - RNA, 10 nt, Unknown
  source: /note="Description of Unknown: Exemplary gene or splice site sequence"
cucguaaguu

SEQ ID NO: 1677 - RNA, 10 nt, Unknown
  source: /note="Description of Unknown: Exemplary gene or splice site sequence"
cucguaucug

SEQ ID NO: 1678 - RNA, 10 nt, Unknown
  source: /note="Description of Unknown: Exemplary gene or splice site sequence"
cucgucugug

SEQ ID NO: 1679 - RNA, 10 nt, Unknown
  source: /note="Description of Unknown: Exemplary gene or splice site sequence"
cucgugaaua

SEQ ID NO: 1680 - RNA, 10 nt, Unknown
  source: /note="Description of Unknown: Exemplary gene or splice site sequence"
cucgugagua

SEQ ID NO: 1681 - RNA, 10 nt, Unknown
  source: /note="Description of Unknown: Exemplary gene or splice site sequence"
cucgugauua

SEQ ID NO: 1682 - RNA, 10 nt, Unknown
  source: /note="Description of Unknown: Exemplary gene or splice site sequence"
cugguaaaaa

SEQ ID NO: 1683 - RNA, 10 nt, Unknown
  source: /note="Description of Unknown: Exemplary gene or splice site sequence"
cugguaaaau

SEQ ID NO: 1684 - RNA, 10 nt, Unknown
  source: /note="Description of Unknown: Exemplary gene or splice site sequence"
cugguaaacc

SEQ ID NO: 1685 - RNA, 10 nt, Unknown
  source: /note="Description of Unknown: Exemplary gene or splice site sequence"
cugguaaacg

SEQ ID NO: 1686 - RNA, 10 nt, Unknown
  source: /note="Description of Unknown: Exemplary gene or splice site sequence"
cugguaaagc

SEQ ID NO: 1687 - RNA, 10 nt, Unknown
  source: /note="Description of Unknown: Exemplary gene or splice site sequence"
cugguaaaua

SEQ ID NO: 1688 - RNA, 10 nt, Unknown
  source: /note="Description of Unknown: Exemplary gene or splice site sequence"
cugguaaauc

SEQ ID NO: 1689 - RNA, 10 nt, Unknown
  source: /note="Description of Unknown: Exemplary gene or splice site sequence"
cugguaaaug

SEQ ID NO: 1690 - RNA, 10 nt, Unknown
  source: /note="Description of Unknown: Exemplary gene or splice site sequence"
cugguaaauu

SEQ ID NO: 1691 - RNA, 10 nt, Unknown
  source: /note="Description of Unknown: Exemplary gene or splice site sequence"
cugguaacac

SEQ ID NO: 1692 - RNA, 10 nt, Unknown
  source: /note="Description of Unknown: Exemplary gene or splice site sequence"
cugguaacag

SEQ ID NO: 1693 - RNA, 10 nt, Unknown
  source: /note="Description of Unknown: Exemplary gene or splice site sequence"
cugguaaccc

SEQ ID NO: 1694 - RNA, 10 nt, Unknown
  source: /note="Description of Unknown: Exemplary gene or splice site sequence"
cugguaaccg

SEQ ID NO: 1695 - RNA, 10 nt, Unknown
  source: /note="Description of Unknown: Exemplary gene or splice site sequence"
cugguaacug

SEQ ID NO: 1696 - RNA, 10 nt, Unknown
  source: /note="Description of Unknown: Exemplary gene or splice site sequence"
cugguaacuu

SEQ ID NO: 1697 - RNA, 10 nt, Unknown
  source: /note="Description of Unknown: Exemplary gene or splice site sequence"
cugguaagaa

SEQ ID NO: 1698 - RNA, 10 nt, Unknown
  source: /note="Description of Unknown: Exemplary gene or splice site sequence"
cugguaagag

SEQ ID NO: 1699 - RNA, 10 nt, Unknown
  source: /note="Description of Unknown: Exemplary gene or splice site sequence"
cugguaagau

SEQ ID NO: 1700 - RNA, 10 nt, Unknown
  source: /note="Description of Unknown: Exemplary gene or splice site sequence"
cugguaagca

SEQ ID NO: 1701 - RNA, 10 nt, Unknown
  source: /note="Description of Unknown: Exemplary gene or splice site sequence"
cugguaagcc

SEQ ID NO: 1702 - RNA, 10 nt, Unknown
  source: /note="Description of Unknown: Exemplary gene or splice site sequence"
cugguaagcu

SEQ ID NO: 1703 - RNA, 10 nt, Unknown
  source: /note="Description of Unknown: Exemplary gene or splice site sequence"
cugguaagga

SEQ ID NO: 1704 - RNA, 10 nt, Unknown
  source: /note="Description of Unknown: Exemplary gene or splice site sequence"
cugguaaggc

SEQ ID NO: 1705 - RNA, 10 nt, Unknown
  source: /note="Description of Unknown: Exemplary gene or splice site sequence"
cugguaaggg

SEQ ID NO: 1706 - RNA, 10 nt, Unknown
  source: /note="Description of Unknown: Exemplary gene or splice site sequence"
cugguaaggu

SEQ ID NO: 1707 - RNA, 10 nt, Unknown
  source: /note="Description of Unknown: Exemplary gene or splice site sequence"
cugguaagua

SEQ ID NO: 1708 - RNA, 10 nt, Unknown
  source: /note="Description of Unknown: Exemplary gene or splice site sequence"
cugguaagug

SEQ ID NO: 1709 - RNA, 10 nt, Unknown
  source: /note="Description of Unknown: Exemplary gene or splice site sequence"
cugguaaguu

SEQ ID NO: 1710 - RNA, 10 nt, Unknown
  source: /note="Description of Unknown: Exemplary gene or splice site sequence"
cugguaauga

SEQ ID NO: 1711 - RNA, 10 nt, Unknown
  source: /note="Description of Unknown: Exemplary gene or splice site sequence"
cugguaaugc

SEQ ID NO: 1712 - RNA, 10 nt, Unknown
  source: /note="Description of Unknown: Exemplary gene or splice site sequence"
cugguaauuc

SEQ ID NO: 1713 - RNA, 10 nt, Unknown
  source: /note="Description of Unknown: Exemplary gene or splice site sequence"
cugguaauuu

SEQ ID NO: 1714 - RNA, 10 nt, Unknown
  source: /note="Description of Unknown: Exemplary gene or splice site sequence"
cugguacaac

SEQ ID NO: 1715 - RNA, 10 nt, Unknown
  source: /note="Description of Unknown: Exemplary gene or splice site sequence"
cugguacaau

SEQ ID NO: 1716 - RNA, 10 nt, Unknown
  source: /note="Description of Unknown: Exemplary gene or splice site sequence"
cugguacaga

SEQ ID NO: 1717 - RNA, 10 nt, Unknown
  source: /note="Description of Unknown: Exemplary gene or splice site sequence"
cugguacaua

SEQ ID NO: 1718 - RNA, 10 nt, Unknown
  source: /note="Description of Unknown: Exemplary gene or splice site sequence"
cugguacauu

SEQ ID NO: 1719 - RNA, 10 nt, Unknown
  source: /note="Description of Unknown: Exemplary gene or splice site sequence"
cugguaccau

SEQ ID NO: 1720 - RNA, 10 nt, Unknown
  source: /note="Description of Unknown: Exemplary gene or splice site sequence"
cugguacguu

SEQ ID NO: 1721 - RNA, 10 nt, Unknown
  source: /note="Description of Unknown: Exemplary gene or splice site sequence"
cugguacuaa

SEQ ID NO: 1722 - RNA, 10 nt, Unknown
  source: /note="Description of Unknown: Exemplary gene or splice site sequence"
cugguacuug

SEQ ID NO: 1723 - RNA, 10 nt, Unknown
  source: /note="Description of Unknown: Exemplary gene or splice site sequence"
cugguacuuu

SEQ ID NO: 1724 - RNA, 10 nt, Unknown
  source: /note="Description of Unknown: Exemplary gene or splice site sequence"
cugguagaga

SEQ ID NO: 1725 - RNA, 10 nt, Unknown
  source: /note="Description of Unknown: Exemplary gene or splice site sequence"
cugguagaua

SEQ ID NO: 1726 - RNA, 10 nt, Unknown
  source: /note="Description of Unknown: Exemplary gene or splice site sequence"
cugguagcgu

SEQ ID NO: 1727 - RNA, 10 nt, Unknown
  source: /note="Description of Unknown: Exemplary gene or splice site sequence"
cugguaggau

SEQ ID NO: 1728 - RNA, 10 nt, Unknown
  source: /note="Description of Unknown: Exemplary gene or splice site sequence"
cugguaggca

SEQ ID NO: 1729 - RNA, 10 nt, Unknown
  source: /note="Description of Unknown: Exemplary gene or splice site sequence"
cugguaggua

SEQ ID NO: 1730 - RNA, 10 nt, Unknown
  source: /note="Description of Unknown: Exemplary gene or splice site sequence"
cugguagguc

SEQ ID NO: 1731 - RNA, 10 nt, Unknown
  source: /note="Description of Unknown: Exemplary gene or splice site sequence"
cugguaggug

SEQ ID NO: 1732 - RNA, 10 nt, Unknown
  source: /note="Description of Unknown: Exemplary gene or splice site sequence"
cugguaucaa

SEQ ID NO: 1733 - RNA, 10 nt, Unknown
  source: /note="Description of Unknown: Exemplary gene or splice site sequence"
cugguaugau

SEQ ID NO: 1734 - RNA, 10 nt, Unknown
  source: /note="Description of Unknown: Exemplary gene or splice site sequence"
cugguauggc

SEQ ID NO: 1735 - RNA, 10 nt, Unknown
  source: /note="Description of Unknown: Exemplary gene or splice site sequence"
cugguauggu

SEQ ID NO: 1736 - RNA, 10 nt, Unknown
  source: /note="Description of Unknown: Exemplary gene or splice site sequence"
cugguaugua

SEQ ID NO: 1737 - RNA, 10 nt, Unknown
  source: /note="Description of Unknown: Exemplary gene or splice site sequence"
cugguaugug

SEQ ID NO: 1738 - RNA, 10 nt, Unknown
  source: /note="Description of Unknown: Exemplary gene or splice site sequence"
cugguauguu

SEQ ID NO: 1739 - RNA, 10 nt, Unknown
  source: /note="Description of Unknown: Exemplary gene or splice site sequence"
cugguauuga

SEQ ID NO: 1740 - RNA, 10 nt, Unknown
  source: /note="Description of Unknown: Exemplary gene or splice site sequence"
cugguauuuc

SEQ ID NO: 1741 - RNA, 10 nt, Unknown
  source: /note="Description of Unknown: Exemplary gene or splice site sequence"
cugguauuuu

SEQ ID NO: 1742 - RNA, 10 nt, Unknown
  source: /note="Description of Unknown: Exemplary gene or splice site sequence"
cuggucaaca

SEQ ID NO: 1743 - RNA, 10 nt, Unknown
  source: /note="Description of Unknown: Exemplary gene or splice site sequence"
cuggucagag

SEQ ID NO: 1744 - RNA, 10 nt, Unknown
  source: /note="Description of Unknown: Exemplary gene or splice site sequence"
cuggucccgc

SEQ ID NO: 1745 - RNA, 10 nt, Unknown
  source: /note="Description of Unknown: Exemplary gene or splice site sequence"
cuggucggua

SEQ ID NO: 1746 - RNA, 10 nt, Unknown
  source: /note="Description of Unknown: Exemplary gene or splice site sequence"
cuggucuggg

SEQ ID NO: 1747 - RNA, 10 nt, Unknown
  source: /note="Description of Unknown: Exemplary gene or splice site sequence"
cuggugaagu

SEQ ID NO: 1748 - RNA, 10 nt, Unknown
  source: /note="Description of Unknown: Exemplary gene or splice site sequence"
cuggugaaua

SEQ ID NO: 1749 - RNA, 10 nt, Unknown
  source: /note="Description of Unknown: Exemplary gene or splice site sequence"
cuggugaauu

SEQ ID NO: 1750 - RNA, 10 nt, Unknown
  source: /note="Description of Unknown: Exemplary gene or splice site sequence"
cuggugacua

SEQ ID NO: 1751 - RNA, 10 nt, Unknown
  source: /note="Description of Unknown: Exemplary gene or splice site sequence"
cuggugagaa

SEQ ID NO: 1752 - RNA, 10 nt, Unknown
  source: /note="Description of Unknown: Exemplary gene or splice site sequence"
cuggugagac

SEQ ID NO: 1753 - RNA, 10 nt, Unknown
  source: /note="Description of Unknown: Exemplary gene or splice site sequence"
cuggugagca

SEQ ID NO: 1754 - RNA, 10 nt, Unknown
  source: /note="Description of Unknown: Exemplary gene or splice site sequence"
cuggugagcu

SEQ ID NO: 1755 - RNA, 10 nt, Unknown
  source: /note="Description of Unknown: Exemplary gene or splice site sequence"
cuggugagga

SEQ ID NO: 1756 - RNA, 10 nt, Unknown
  source: /note="Description of Unknown: Exemplary gene or splice site sequence"
cuggugaggc

SEQ ID NO: 1757 - RNA, 10 nt, Unknown
  source: /note="Description of Unknown: Exemplary gene or splice site sequence"
cuggugaggg

SEQ ID NO: 1758 - RNA, 10 nt, Unknown
  source: /note="Description of Unknown: Exemplary gene or splice site sequence"
cuggugaggu

SEQ ID NO: 1759 - RNA, 10 nt, Unknown
  source: /note="Description of Unknown: Exemplary gene or splice site sequence"
cuggugagua

SEQ ID NO: 1760 - RNA, 10 nt, Unknown
  source: /note="Description of Unknown: Exemplary gene or splice site sequence"
cuggugaguc

SEQ ID NO: 1761 - RNA, 10 nt, Unknown
  source: /note="Description of Unknown: Exemplary gene or splice site sequence"
cuggugagug

SEQ ID NO: 1762 - RNA, 10 nt, Unknown
  source: /note="Description of Unknown: Exemplary gene or splice site sequence"
cuggugaguu

SEQ ID NO: 1763 - RNA, 10 nt, Unknown
  source: /note="Description of Unknown: Exemplary gene or splice site sequence"
cuggugauua

SEQ ID NO: 1764 - RNA, 10 nt, Unknown
  source: /note="Description of Unknown: Exemplary gene or splice site sequence"
cuggugauuu

SEQ ID NO: 1765 - RNA, 10 nt, Unknown
  source: /note="Description of Unknown: Exemplary gene or splice site sequence"
cuggugcaga

SEQ ID NO: 1766 - RNA, 10 nt, Unknown
  source: /note="Description of Unknown: Exemplary gene or splice site sequence"
cuggugcgcu

SEQ ID NO: 1767 - RNA, 10 nt, Unknown
  source: /note="Description of Unknown: Exemplary gene or splice site sequence"
cuggugcgug

SEQ ID NO: 1768 - RNA, 10 nt, Unknown
  source: /note="Description of Unknown: Exemplary gene or splice site sequence"
cuggugcuga

SEQ ID NO: 1769 - RNA, 10 nt, Unknown
  source: /note="Description of Unknown: Exemplary gene or splice site sequence"
cuggugggag

SEQ ID NO: 1770 - RNA, 10 nt, Unknown
  source: /note="Description of Unknown: Exemplary gene or splice site sequence"
cuggugggga

SEQ ID NO: 1771 - RNA, 10 nt, Unknown
  source: /note="Description of Unknown: Exemplary gene or splice site sequence"
cuggugggua

SEQ ID NO: 1772 - RNA, 10 nt, Unknown
  source: /note="Description of Unknown: Exemplary gene or splice site sequence"
cugguggguc

SEQ ID NO: 1773 - RNA, 10 nt, Unknown
  source: /note="Description of Unknown: Exemplary gene or splice site sequence"
cuggugggug

SEQ ID NO: 1774 - RNA, 10 nt, Unknown
  source: /note="Description of Unknown: Exemplary gene or splice site sequence"
cugguggguu

SEQ ID NO: 1775 - RNA, 10 nt, Unknown
  source: /note="Description of Unknown: Exemplary gene or splice site sequence"
cuggugugaa

SEQ ID NO: 1776 - RNA, 10 nt, Unknown
  source: /note="Description of Unknown: Exemplary gene or splice site sequence"
cuggugugca

SEQ ID NO: 1777 - RNA, 10 nt, Unknown
  source: /note="Description of Unknown: Exemplary gene or splice site sequence"
cuggugugcu

SEQ ID NO: 1778 - RNA, 10 nt, Unknown
  source: /note="Description of Unknown: Exemplary gene or splice site sequence"
cugguguggu

SEQ ID NO: 1779 - RNA, 10 nt, Unknown
  source: /note="Description of Unknown: Exemplary gene or splice site sequence"
cuggugugug

SEQ ID NO: 1780 - RNA, 10 nt, Unknown
  source: /note="Description of Unknown: Exemplary gene or splice site sequence"
cugguguguu

SEQ ID NO: 1781 - RNA, 10 nt, Unknown
  source: /note="Description of Unknown: Exemplary gene or splice site sequence"
cugguuagcu

SEQ ID NO: 1782 - RNA, 10 nt, Unknown
  source: /note="Description of Unknown: Exemplary gene or splice site sequence"
cugguuagug

SEQ ID NO: 1783 - RNA, 10 nt, Unknown
  source: /note="Description of Unknown: Exemplary gene or splice site sequence"
cugguucgug

SEQ ID NO: 1784 - RNA, 10 nt, Unknown
  source: /note="Description of Unknown: Exemplary gene or splice site sequence"
cugguuggcu

SEQ ID NO: 1785 - RNA, 10 nt, Unknown
  source: /note="Description of Unknown: Exemplary gene or splice site sequence"
cugguuguuu

SEQ ID NO: 1786 - RNA, 10 nt, Unknown
  source: /note="Description of Unknown: Exemplary gene or splice site sequence"
cugguuugua

SEQ ID NO: 1787 - RNA, 10 nt, Unknown
  source: /note="Description of Unknown: Exemplary gene or splice site sequence"
cugguuuguc

SEQ ID NO: 1788 - RNA, 10 nt, Unknown
  source: /note="Description of Unknown: Exemplary gene or splice site sequence"
cugguuugug

SEQ ID NO: 1789 - RNA, 10 nt, Unknown
  source: /note="Description of Unknown: Exemplary gene or splice site sequence"
cuuguaaaug

SEQ ID NO: 1790 - RNA, 10 nt, Unknown
  source: /note="Description of Unknown: Exemplary gene or splice site sequence"
cuuguaagcu

SEQ ID NO: 1791 - RNA, 10 nt, Unknown
  source: /note="Description of Unknown: Exemplary gene or splice site sequence"
cuuguaagga

SEQ ID NO: 1792 - RNA, 10 nt, Unknown
  source: /note="Description of Unknown: Exemplary gene or splice site sequence"
cuuguaaggc

SEQ ID NO: 1793 - RNA, 10 nt, Unknown
  source: /note="Description of Unknown: Exemplary gene or splice site sequence"
cuuguaagua

SEQ ID NO: 1794 - RNA, 10 nt, Unknown
  source: /note="Description of Unknown: Exemplary gene or splice site sequence"
cuuguaagug

SEQ ID NO: 1795 - RNA, 10 nt, Unknown
  source: /note="Description of Unknown: Exemplary gene or splice site sequence"
cuuguaaguu

SEQ ID NO: 1796 - RNA, 10 nt, Unknown
  source: /note="Description of Unknown: Exemplary gene or splice site sequence"
cuuguacguc

SEQ ID NO: 1797 - RNA, 10 nt, Unknown
  source: /note="Description of Unknown: Exemplary gene or splice site sequence"
cuuguacgug

SEQ ID NO: 1798 - RNA, 10 nt, Unknown
  source: /note="Description of Unknown: Exemplary gene or splice site sequence"
cuuguaggua

SEQ ID NO: 1799 - RNA, 10 nt, Unknown
  source: /note="Description of Unknown: Exemplary gene or splice site sequence"
cuuguagugc

SEQ ID NO: 1800 - RNA, 10 nt, Unknown
  source: /note="Description of Unknown: Exemplary gene or splice site sequence"
cuuguauagg

SEQ ID NO: 1801 - RNA, 10 nt, Unknown
  source: /note="Description of Unknown: Exemplary gene or splice site sequence"
cuugucagua

SEQ ID NO: 1802 - RNA, 10 nt, Unknown
  source: /note="Description of Unknown: Exemplary gene or splice site sequence"
cuugugagua

SEQ ID NO: 1803 - RNA, 10 nt, Unknown
  source: /note="Description of Unknown: Exemplary gene or splice site sequence"
cuugugaguc

SEQ ID NO: 1804 - RNA, 10 nt, Unknown
  source: /note="Description of Unknown: Exemplary gene or splice site sequence"
cuugugaguu

SEQ ID NO: 1805 - RNA, 10 nt, Unknown
  source: /note="Description of Unknown: Exemplary gene or splice site sequence"
cuuguggguu

SEQ ID NO: 1806 - RNA, 10 nt, Unknown
  source: /note="Description of Unknown: Exemplary gene or splice site sequence"
cuugugugua

SEQ ID NO: 1807 - RNA, 10 nt, Unknown
  source: /note="Description of Unknown: Exemplary gene or splice site sequence"
cuuguuagug

SEQ ID NO: 1808 - RNA, 10 nt, Unknown
  source: /note="Description of Unknown: Exemplary gene or splice site sequence"
cuuguuugag

SEQ ID NO: 1809 - RNA, 10 nt, Unknown
  source: /note="Description of Unknown: Exemplary gene or splice site sequence"
gaaguaaaac

SEQ ID NO: 1810 - RNA, 10 nt, Unknown
  source: /note="Description of Unknown: Exemplary gene or splice site sequence"
gaaguaaagc

SEQ ID NO: 1811 - RNA, 10 nt, Unknown
  source: /note="Description of Unknown: Exemplary gene or splice site sequence"
gaaguaaagu

SEQ ID NO: 1812 - RNA, 10 nt, Unknown
  source: /note="Description of Unknown: Exemplary gene or splice site sequence"
gaaguaaaua

SEQ ID NO: 1813 - RNA, 10 nt, Unknown
  source: /note="Description of Unknown: Exemplary gene or splice site sequence"
gaaguaaauu

SEQ ID NO: 1814 - RNA, 10 nt, Unknown
  source: /note="Description of Unknown: Exemplary gene or splice site sequence"
gaaguaagaa

SEQ ID NO: 1815 - RNA, 10 nt, Unknown
  source: /note="Description of Unknown: Exemplary gene or splice site sequence"
gaaguaagcc

SEQ ID NO: 1816 - RNA, 10 nt, Unknown
  source: /note="Description of Unknown: Exemplary gene or splice site sequence"
gaaguaagcu

SEQ ID NO: 1817 - RNA, 10 nt, Unknown
  source: /note="Description of Unknown: Exemplary gene or splice site sequence"
gaaguaagga

SEQ ID NO: 1818 - RNA, 10 nt, Unknown
  source: /note="Description of Unknown: Exemplary gene or splice site sequence"
gaaguaagua

SEQ ID NO: 1819 - RNA, 10 nt, Unknown
  source: /note="Description of Unknown: Exemplary gene or splice site sequence"
gaaguaagug

SEQ ID NO: 1820 - RNA, 10 nt, Unknown
  source: /note="Description of Unknown: Exemplary gene or splice site sequence"
gaaguaaguu

SEQ ID NO: 1821 - RNA, 10 nt, Unknown
  source: /note="Description of Unknown: Exemplary gene or splice site sequence"
gaaguaauau

SEQ ID NO: 1822 - RNA, 10 nt, Unknown
  source: /note="Description of Unknown: Exemplary gene or splice site sequence"
gaaguaaugc

SEQ ID NO: 1823 - RNA, 10 nt, Unknown
  source: /note="Description of Unknown: Exemplary gene or splice site sequence"
gaaguaauua

SEQ ID NO: 1824 - RNA, 10 nt, Unknown
  source: /note="Description of Unknown: Exemplary gene or splice site sequence"
gaaguaauuu

SEQ ID NO: 1825 - RNA, 10 nt, Unknown
  source: /note="Description of Unknown: Exemplary gene or splice site sequence"
gaaguaccau

SEQ ID NO: 1826 - RNA, 10 nt, Unknown
  source: /note="Description of Unknown: Exemplary gene or splice site sequence"
gaaguacgua

SEQ ID NO: 1827 - RNA, 10 nt, Unknown
  source: /note="Description of Unknown: Exemplary gene or splice site sequence"
gaaguacguc

SEQ ID NO: 1828 - RNA, 10 nt, Unknown
  source: /note="Description of Unknown: Exemplary gene or splice site sequence"
gaaguaggca

SEQ ID NO: 1829 - RNA, 10 nt, Unknown
  source: /note="Description of Unknown: Exemplary gene or splice site sequence"
gaaguagguc

SEQ ID NO: 1830 - RNA, 10 nt, Unknown
  source: /note="Description of Unknown: Exemplary gene or splice site sequence"
gaaguauaaa

SEQ ID NO: 1831 - RNA, 10 nt, Unknown
  source: /note="Description of Unknown: Exemplary gene or splice site sequence"
gaaguaugcu

SEQ ID NO: 1832 - RNA, 10 nt, Unknown
  source: /note="Description of Unknown: Exemplary gene or splice site sequence"
gaaguaugug

SEQ ID NO: 1833 - RNA, 10 nt, Unknown
  source: /note="Description of Unknown: Exemplary gene or splice site sequence"
gaaguauguu

SEQ ID NO: 1834 - RNA, 10 nt, Unknown
  source: /note="Description of Unknown: Exemplary gene or splice site sequence"
gaaguauuaa

SEQ ID NO: 1835 - RNA, 10 nt, Unknown
  source: /note="Description of Unknown: Exemplary gene or splice site sequence"
gaagucagug

SEQ ID NO: 1836 - RNA, 10 nt, Unknown
  source: /note="Description of Unknown: Exemplary gene or splice site sequence"
gaagugagag

SEQ ID NO: 1837 - RNA, 10 nt, Unknown
  source: /note="Description of Unknown: Exemplary gene or splice site sequence"
gaagugagcg

SEQ ID NO: 1838 - RNA, 10 nt, Unknown
  source: /note="Description of Unknown: Exemplary gene or splice site sequence"
gaagugaggu

SEQ ID NO: 1839 - RNA, 10 nt, Unknown
  source: /note="Description of Unknown: Exemplary gene or splice site sequence"
gaagugaguc

SEQ ID NO: 1840 - RNA, 10 nt, Unknown
  source: /note="Description of Unknown: Exemplary gene or splice site sequence"
gaagugagug

SEQ ID NO: 1841 - RNA, 10 nt, Unknown
  source: /note="Description of Unknown: Exemplary gene or splice site sequence"
gaagugaguu

SEQ ID NO: 1842 - RNA, 10 nt, Unknown
  source: /note="Description of Unknown: Exemplary gene or splice site sequence"
gaagugauaa

SEQ ID NO: 1843 - RNA, 10 nt, Unknown
  source: /note="Description of Unknown: Exemplary gene or splice site sequence"
gaagugauuc

SEQ ID NO: 1844 - RNA, 10 nt, Unknown
  source: /note="Description of Unknown: Exemplary gene or splice site sequence"
gaagugcgug

SEQ ID NO: 1845 - RNA, 10 nt, Unknown
  source: /note="Description of Unknown: Exemplary gene or splice site sequence"
gaaguguggg

SEQ ID NO: 1846 - RNA, 10 nt, Unknown
  source: /note="Description of Unknown: Exemplary gene or splice site sequence"
gaaguguguc

SEQ ID NO: 1847 - RNA, 10 nt, Unknown
  source: /note="Description of Unknown: Exemplary gene or splice site sequence"
gaaguuggug

SEQ ID NO: 1848 - RNA, 10 nt, Unknown
  source: /note="Description of Unknown: Exemplary gene or splice site sequence"
gacguaaagu

SEQ ID NO: 1849 - RNA, 10 nt, Unknown
  source: /note="Description of Unknown: Exemplary gene or splice site sequence"
gacguaagcu

SEQ ID NO: 1850 - RNA, 10 nt, Unknown
  source: /note="Description of Unknown: Exemplary gene or splice site sequence"
gacguaagua

SEQ ID NO: 1851 - RNA, 10 nt, Unknown
  source: /note="Description of Unknown: Exemplary gene or splice site sequence"
gacguaaugg

SEQ ID NO: 1852 - RNA, 10 nt, Unknown
  source: /note="Description of Unknown: Exemplary gene or splice site sequence"
gacguaugcc

SEQ ID NO: 1853 - RNA, 10 nt, Unknown
  source: /note="Description of Unknown: Exemplary gene or splice site sequence"
gacguauguu

SEQ ID NO: 1854 - RNA, 10 nt, Unknown
  source: /note="Description of Unknown: Exemplary gene or splice site sequence"
gacgugagcc

SEQ ID NO: 1855 - RNA, 10 nt, Unknown
  source: /note="Description of Unknown: Exemplary gene or splice site sequence"
gacgugagug

SEQ ID NO: 1856 - RNA, 10 nt, Unknown
  source: /note="Description of Unknown: Exemplary gene or splice site sequence"
gaggcaaaug

SEQ ID NO: 1857 - RNA, 10 nt, Unknown
  source: /note="Description of Unknown: Exemplary gene or splice site sequence"
gaggcaagag

SEQ ID NO: 1858 - RNA, 10 nt, Unknown
  source: /note="Description of Unknown: Exemplary gene or splice site sequence"
gaggcaagua

SEQ ID NO: 1859 - RNA, 10 nt, Unknown
  source: /note="Description of Unknown: Exemplary gene or splice site sequence"
gaggcaagug

SEQ ID NO: 1860 - RNA, 10 nt, Unknown
  source: /note="Description of Unknown: Exemplary gene or splice site sequence"
gaggcaaguu

SEQ ID NO: 1861 - RNA, 10 nt, Unknown
  source: /note="Description of Unknown: Exemplary gene or splice site sequence"
gaggcacgag

SEQ ID NO: 1862 - RNA, 10 nt, Unknown
  source: /note="Description of Unknown: Exemplary gene or splice site sequence"
gaggcaggga

SEQ ID NO: 1863 - RNA, 10 nt, Unknown
  source: /note="Description of Unknown: Exemplary gene or splice site sequence"
gaggcaugug

SEQ ID NO: 1864 - RNA, 10 nt, Unknown
  source: /note="Description of Unknown: Exemplary gene or splice site sequence"
gaggcgaagg

SEQ ID NO: 1865 - RNA, 10 nt, Unknown
  source: /note="Description of Unknown: Exemplary gene or splice site sequence"
gagguaaaaa

SEQ ID NO: 1866 - RNA, 10 nt, Unknown
  source: /note="Description of Unknown: Exemplary gene or splice site sequence"
gagguaaaac

SEQ ID NO: 1867 - RNA, 10 nt, Unknown
  source: /note="Description of Unknown: Exemplary gene or splice site sequence"
gagguaaaag

SEQ ID NO: 1868 - RNA, 10 nt, Unknown
  source: /note="Description of Unknown: Exemplary gene or splice site sequence"
gagguaaaau

SEQ ID NO: 1869 - RNA, 10 nt, Unknown
  source: /note="Description of Unknown: Exemplary gene or splice site sequence"
gagguaaacc

SEQ ID NO: 1870 - RNA, 10 nt, Unknown
  source: /note="Description of Unknown: Exemplary gene or splice site sequence"
gagguaaaga

SEQ ID NO: 1871 - RNA, 10 nt, Unknown
  source: /note="Description of Unknown: Exemplary gene or splice site sequence"
gagguaaagc

SEQ ID NO: 1872 - RNA, 10 nt, Unknown
  source: /note="Description of Unknown: Exemplary gene or splice site sequence"
gagguaaagu

SEQ ID NO: 1873 - RNA, 10 nt, Unknown
  source: /note="Description of Unknown: Exemplary gene or splice site sequence"
gagguaaaua

SEQ ID NO: 1874 - RNA, 10 nt, Unknown
  source: /note="Description of Unknown: Exemplary gene or splice site sequence"
gagguaaauc

SEQ ID NO: 1875 - RNA, 10 nt, Unknown
  source: /note="Description of Unknown: Exemplary gene or splice site sequence"
gagguaaaug

SEQ ID NO: 1876 - RNA, 10 nt, Unknown
  source: /note="Description of Unknown: Exemplary gene or splice site sequence"
gagguaaauu

SEQ ID NO: 1877 - RNA, 10 nt, Unknown
  source: /note="Description of Unknown: Exemplary gene or splice site sequence"
gagguaacaa

SEQ ID NO: 1878 - RNA, 10 nt, Unknown
  source: /note="Description of Unknown: Exemplary gene or splice site sequence"
gagguaacag

SEQ ID NO: 1879 - RNA, 10 nt, Unknown
  source: /note="Description of Unknown: Exemplary gene or splice site sequence"
gagguaacca

SEQ ID NO: 1880 - RNA, 10 nt, Unknown
  source: /note="Description of Unknown: Exemplary gene or splice site sequence"
gagguaaccu

SEQ ID NO: 1881 - RNA, 10 nt, Unknown
  source: /note="Description of Unknown: Exemplary gene or splice site sequence"
gagguaacuu

SEQ ID NO: 1882 - RNA, 10 nt, Unknown
  source: /note="Description of Unknown: Exemplary gene or splice site sequence"
gagguaagaa

SEQ ID NO: 1883 - RNA, 10 nt, Unknown
  source: /note="Description of Unknown: Exemplary gene or splice site sequence"
gagguaagag

SEQ ID NO: 1884 - RNA, 10 nt, Unknown
  source: /note="Description of Unknown: Exemplary gene or splice site sequence"
gagguaagau

SEQ ID NO: 1885 - RNA, 10 nt, Unknown
  source: /note="Description of Unknown: Exemplary gene or splice site sequence"
gagguaagca

SEQ ID NO: 1886 - RNA, 10 nt, Unknown
  source: /note="Description of Unknown: Exemplary gene or splice site sequence"
gagguaagcc

SEQ ID NO: 1887 - RNA, 10 nt, Unknown
  source: /note="Description of Unknown: Exemplary gene or splice site sequence"
gagguaagcg

SEQ ID NO: 1888 - RNA, 10 nt, Unknown
  source: /note="Description of Unknown: Exemplary gene or splice site sequence"
gagguaagcu

SEQ ID NO: 1889 - RNA, 10 nt, Unknown
  source: /note="Description of Unknown: Exemplary gene or splice site sequence"
gagguaagga

SEQ ID NO: 1890 - RNA, 10 nt, Unknown
  source: /note="Description of Unknown: Exemplary gene or splice site sequence"
gagguaaggc

SEQ ID NO: 1891 - RNA, 10 nt, Unknown
  source: /note="Description of Unknown: Exemplary gene or splice site sequence"
gagguaaggg

SEQ ID NO: 1892 - RNA, 10 nt, Unknown
  source: /note="Description of Unknown: Exemplary gene or splice site sequence"
gagguaaggu

SEQ ID NO: 1893 - RNA, 10 nt, Unknown
  source: /note="Description of Unknown: Exemplary gene or splice site sequence"
gagguaagua

SEQ ID NO: 1894 - RNA, 10 nt, Unknown
  source: /note="Description of Unknown: Exemplary gene or splice site sequence"
gagguaaguc

SEQ ID NO: 1895 - RNA, 10 nt, Unknown
  source: /note="Description of Unknown: Exemplary gene or splice site sequence"
gagguaauaa

SEQ ID NO: 1896 - RNA, 10 nt, Unknown
  source: /note="Description of Unknown: Exemplary gene or splice site sequence"
gagguaauac

SEQ ID NO: 1897 - RNA, 10 nt, Unknown
  source: /note="Description of Unknown: Exemplary gene or splice site sequence"
gagguaauau

SEQ ID NO: 1898 - RNA, 10 nt, Unknown
  source: /note="Description of Unknown: Exemplary gene or splice site sequence"
gagguaauca

SEQ ID NO: 1899 - RNA, 10 nt, Unknown
  source: /note="Description of Unknown: Exemplary gene or splice site sequence"
gagguaaucu

SEQ ID NO: 1900 - RNA, 10 nt, Unknown
  source: /note="Description of Unknown: Exemplary gene or splice site sequence"
gagguaaugg

SEQ ID NO: 1901 - RNA, 10 nt, Unknown
  source: /note="Description of Unknown: Exemplary gene or splice site sequence"
gagguaaugu

SEQ ID NO: 1902 - RNA, 10 nt, Unknown
  source: /note="Description of Unknown: Exemplary gene or splice site sequence"
gagguaauug

SEQ ID NO: 1903 - RNA, 10 nt, Unknown
  source: /note="Description of Unknown: Exemplary gene or splice site sequence"
gagguaauuu

SEQ ID NO: 1904 - RNA, 10 nt, Unknown
  source: /note="Description of Unknown: Exemplary gene or splice site sequence"
gagguacaaa

SEQ ID NO: 1905 - RNA, 10 nt, Unknown
  source: /note="Description of Unknown: Exemplary gene or splice site sequence"
gagguacaac

SEQ ID NO: 1906 - RNA, 10 nt, Unknown
  source: /note="Description of Unknown: Exemplary gene or splice site sequence"
gagguacaga

SEQ ID NO: 1907 - RNA, 10 nt, Unknown
  source: /note="Description of Unknown: Exemplary gene or splice site sequence"
gagguacagc

SEQ ID NO: 1908 - RNA, 10 nt, Unknown
  source: /note="Description of Unknown: Exemplary gene or splice site sequence"
gagguacagu

SEQ ID NO: 1909 - RNA, 10 nt, Unknown
  source: /note="Description of Unknown: Exemplary gene or splice site sequence"
gagguacaua

SEQ ID NO: 1910 - RNA, 10 nt, Unknown
  source: /note="Description of Unknown: Exemplary gene or splice site sequence"
gagguacauu

SEQ ID NO: 1911 - RNA, 10 nt, Unknown
  source: /note="Description of Unknown: Exemplary gene or splice site sequence"
gagguaccag

SEQ ID NO: 1912 - RNA, 10 nt, Unknown
  source: /note="Description of Unknown: Exemplary gene or splice site sequence"
gagguaccga

SEQ ID NO: 1913 - RNA, 10 nt, Unknown
  source: /note="Description of Unknown: Exemplary gene or splice site sequence"
gagguaccug

SEQ ID NO: 1914 - RNA, 10 nt, Unknown
  source: /note="Description of Unknown: Exemplary gene or splice site sequence"
gagguaccuu

SEQ ID NO: 1915 - RNA, 10 nt, Unknown
  source: /note="Description of Unknown: Exemplary gene or splice site sequence"
gagguacuag

SEQ ID NO: 1916 - RNA, 10 nt, Unknown
  source: /note="Description of Unknown: Exemplary gene or splice site sequence"
gagguacuau

SEQ ID NO: 1917 - RNA, 10 nt, Unknown
  source: /note="Description of Unknown: Exemplary gene or splice site sequence"
gagguacucc

SEQ ID NO: 1918 - RNA, 10 nt, Unknown
  source: /note="Description of Unknown: Exemplary gene or splice site sequence"
gagguacugc

SEQ ID NO: 1919 - RNA, 10 nt, Unknown
  source: /note="Description of Unknown: Exemplary gene or splice site sequence"
gagguacugg

SEQ ID NO: 1920 - RNA, 10 nt, Unknown
  source: /note="Description of Unknown: Exemplary gene or splice site sequence"
gagguacugu

SEQ ID NO: 1921 - RNA, 10 nt, Unknown
  source: /note="Description of Unknown: Exemplary gene or splice site sequence"
gagguacuug

SEQ ID NO: 1922 - RNA, 10 nt, Unknown
  source: /note="Description of Unknown: Exemplary gene or splice site sequence"
gagguacuuu

SEQ ID NO: 1923 - RNA, 10 nt, Unknown
  source: /note="Description of Unknown: Exemplary gene or splice site sequence"
gagguagaag

SEQ ID NO: 1924 - RNA, 10 nt, Unknown
  source: /note="Description of Unknown: Exemplary gene or splice site sequence"
gagguagaga

SEQ ID NO: 1925 - RNA, 10 nt, Unknown
  source: /note="Description of Unknown: Exemplary gene or splice site sequence"
gagguagagg

SEQ ID NO: 1926 - RNA, 10 nt, Unknown
  source: /note="Description of Unknown: Exemplary gene or splice site sequence"
gagguagagu

SEQ ID NO: 1927 - RNA, 10 nt, Unknown
  source: /note="Description of Unknown: Exemplary gene or splice site sequence"
gagguagauc

SEQ ID NO: 1928 - RNA, 10 nt, Unknown
  source: /note="Description of Unknown: Exemplary gene or splice site sequence"
gagguagcua

SEQ ID NO: 1929 - RNA, 10 nt, Unknown
  source: /note="Description of Unknown: Exemplary gene or splice site sequence"
gagguagcug

SEQ ID NO: 1930 - RNA, 10 nt, Unknown
  source: /note="Description of Unknown: Exemplary gene or splice site sequence"
gagguaggaa

SEQ ID NO: 1931 - RNA, 10 nt, Unknown
  source: /note="Description of Unknown: Exemplary gene or splice site sequence"
gagguaggag

SEQ ID NO: 1932 - RNA, 10 nt, Unknown
  source: /note="Description of Unknown: Exemplary gene or splice site sequence"
gagguaggca

SEQ ID NO: 1933 - RNA, 10 nt, Unknown
  source: /note="Description of Unknown: Exemplary gene or splice site sequence"
gagguaggcu

SEQ ID NO: 1934 - RNA, 10 nt, Unknown
  source: /note="Description of Unknown: Exemplary gene or splice site sequence"
gagguaggga

SEQ ID NO: 1935 - RNA, 10 nt, Unknown
  source: /note="Description of Unknown: Exemplary gene or splice site sequence"
gagguagggc

SEQ ID NO: 1936 - RNA, 10 nt, Unknown
  source: /note="Description of Unknown: Exemplary gene or splice site sequence"
gagguagggg

SEQ ID NO: 1937 - RNA, 10 nt, Unknown
  source: /note="Description of Unknown: Exemplary gene or splice site sequence"
gagguaggua

SEQ ID NO: 1938 - RNA, 10 nt, Unknown
  source: /note="Description of Unknown: Exemplary gene or splice site sequence"
gagguaggug

SEQ ID NO: 1939 - RNA, 10 nt, Unknown
  source: /note="Description of Unknown: Exemplary gene or splice site sequence"
gagguagguu

SEQ ID NO: 1940 - RNA, 10 nt, Unknown
  source: /note="Description of Unknown: Exemplary gene or splice site sequence"
gagguaguaa

SEQ ID NO: 1941 - RNA, 10 nt, Unknown
  source: /note="Description of Unknown: Exemplary gene or splice site sequence"
gagguaguag

SEQ ID NO: 1942 - RNA, 10 nt, Unknown
  source: /note="Description of Unknown: Exemplary gene or splice site sequence"
gagguaguau

SEQ ID NO: 1943 - RNA, 10 nt, Unknown
  source: /note="Description of Unknown: Exemplary gene or splice site sequence"
gagguagucu

SEQ ID NO: 1944 - RNA, 10 nt, Unknown
  source: /note="Description of Unknown: Exemplary gene or splice site sequence"
gagguagugc

SEQ ID NO: 1945 - RNA, 10 nt, Unknown
  source: /note="Description of Unknown: Exemplary gene or splice site sequence"
gagguagugg

SEQ ID NO: 1946 - RNA, 10 nt, Unknown
  source: /note="Description of Unknown: Exemplary gene or splice site sequence"
gagguaguua

SEQ ID NO: 1947 - RNA, 10 nt, Unknown
  source: /note="Description of Unknown: Exemplary gene or splice site sequence"
gagguaguug

SEQ ID NO: 1948 - RNA, 10 nt, Unknown
  source: /note="Description of Unknown: Exemplary gene or splice site sequence"
gagguauaag

SEQ ID NO: 1949 - RNA, 10 nt, Unknown
  source: /note="Description of Unknown: Exemplary gene or splice site sequence"
gagguauacu

SEQ ID NO: 1950 - RNA, 10 nt, Unknown
  source: /note="Description of Unknown: Exemplary gene or splice site sequence"
gagguauagc

SEQ ID NO: 1951 - RNA, 10 nt, Unknown
  source: /note="Description of Unknown: Exemplary gene or splice site sequence"
gagguauaug

SEQ ID NO: 1952 - RNA, 10 nt, Unknown
  source: /note="Description of Unknown: Exemplary gene or splice site sequence"
gagguauauu

SEQ ID NO: 1953 - RNA, 10 nt, Unknown
  source: /note="Description of Unknown: Exemplary gene or splice site sequence"
gagguaucau

SEQ ID NO: 1954 - RNA, 10 nt, Unknown
  source: /note="Description of Unknown: Exemplary gene or splice site sequence"
gagguaucug

SEQ ID NO: 1955 - RNA, 10 nt, Unknown
  source: /note="Description of Unknown: Exemplary gene or splice site sequence"
gagguaucuu

SEQ ID NO: 1956 - RNA, 10 nt, Unknown
  source: /note="Description of Unknown: Exemplary gene or splice site sequence"
gagguaugaa

SEQ ID NO: 1957 - RNA, 10 nt, Unknown
  source: /note="Description of Unknown: Exemplary gene or splice site sequence"
gagguaugac

SEQ ID NO: 1958 - RNA, 10 nt, Unknown
  source: /note="Description of Unknown: Exemplary gene or splice site sequence"
gagguaugag

SEQ ID NO: 1959 - RNA, 10 nt, Unknown
  source: /note="Description of Unknown: Exemplary gene or splice site sequence"
gagguaugcc

SEQ ID NO: 1960 - RNA, 10 nt, Unknown
  source: /note="Description of Unknown: Exemplary gene or splice site sequence"
gagguaugcg

SEQ ID NO: 1961 - RNA, 10 nt, Unknown
  source: /note="Description of Unknown: Exemplary gene or splice site sequence"
gagguaugcu

SEQ ID NO: 1962 - RNA, 10 nt, Unknown
  source: /note="Description of Unknown: Exemplary gene or splice site sequence"
gagguaugga

SEQ ID NO: 1963 - RNA, 10 nt, Unknown
  source: /note="Description of Unknown: Exemplary gene or splice site sequence"
gagguauggg

SEQ ID NO: 1964 - RNA, 10 nt, Unknown
  source: /note="Description of Unknown: Exemplary gene or splice site sequence"
gagguauggu

SEQ ID NO: 1965 - RNA, 10 nt, Unknown
  source: /note="Description of Unknown: Exemplary gene or splice site sequence"
gagguaugua

SEQ ID NO: 1966 - RNA, 10 nt, Unknown
  source: /note="Description of Unknown: Exemplary gene or splice site sequence"
gagguauguc

SEQ ID NO: 1967 - RNA, 10 nt, Unknown
  source: /note="Description of Unknown: Exemplary gene or splice site sequence"
gagguaugug

SEQ ID NO: 1968 - RNA, 10 nt, Unknown
  source: /note="Description of Unknown: Exemplary gene or splice site sequence"
gagguauguu

SEQ ID NO: 1969 - RNA, 10 nt, Unknown
  source: /note="Description of Unknown: Exemplary gene or splice site sequence"
gagguauucc

SEQ ID NO: 1970 - RNA, 10 nt, Unknown
  source: /note="Description of Unknown: Exemplary gene or splice site sequence"
gagguauuga

SEQ ID NO: 1971 - RNA, 10 nt, Unknown
  source: /note="Description of Unknown: Exemplary gene or splice site sequence"
gagguauugu

SEQ ID NO: 1972 - RNA, 10 nt, Unknown
  source: /note="Description of Unknown: Exemplary gene or splice site sequence"
gagguauuua

SEQ ID NO: 1973 - RNA, 10 nt, Unknown
  source: /note="Description of Unknown: Exemplary gene or splice site sequence"
gagguauuuc

SEQ ID NO: 1974 - RNA, 10 nt, Unknown
  source: /note="Description of Unknown: Exemplary gene or splice site sequence"
gagguauuug

SEQ ID NO: 1975 - RNA, 10 nt, Unknown
  source: /note="Description of Unknown: Exemplary gene or splice site sequence"
gagguauuuu

SEQ ID NO: 1976 - RNA, 10 nt, Unknown
  source: /note="Description of Unknown: Exemplary gene or splice site sequence"
gaggucaaca

SEQ ID NO: 1977 - RNA, 10 nt, Unknown
  source: /note="Description of Unknown: Exemplary gene or splice site sequence"
gaggucaagg

SEQ ID NO: 1978 - RNA, 10 nt, Unknown
  source: /note="Description of Unknown: Exemplary gene or splice site sequence"
gaggucaaug

SEQ ID NO: 1979 - RNA, 10 nt, Unknown
  source: /note="Description of Unknown: Exemplary gene or splice site sequence"
gaggucacug

SEQ ID NO: 1980 - RNA, 10 nt, Unknown
  source: /note="Description of Unknown: Exemplary gene or splice site sequence"
gaggucagaa

SEQ ID NO: 1981 - RNA, 10 nt, Unknown
  source: /note="Description of Unknown: Exemplary gene or splice site sequence"
gaggucagag

SEQ ID NO: 1982 - RNA, 10 nt, Unknown
  source: /note="Description of Unknown: Exemplary gene or splice site sequence"
gaggucagcu

SEQ ID NO: 1983 - RNA, 10 nt, Unknown
  source: /note="Description of Unknown: Exemplary gene or splice site sequence"
gaggucagga

SEQ ID NO: 1984 - RNA, 10 nt, Unknown
  source: /note="Description of Unknown: Exemplary gene or splice site sequence"
gaggucaggc

SEQ ID NO: 1985 - RNA, 10 nt, Unknown
  source: /note="Description of Unknown: Exemplary gene or splice site sequence"
gaggucaggg

SEQ ID NO: 1986 - RNA, 10 nt, Unknown
  source: /note="Description of Unknown: Exemplary gene or splice site sequence"
gaggucaggu

SEQ ID NO: 1987 - RNA, 10 nt, Unknown
  source: /note="Description of Unknown: Exemplary gene or splice site sequence"
gaggucagua

SEQ ID NO: 1988 - RNA, 10 nt, Unknown
  source: /note="Description of Unknown: Exemplary gene or splice site sequence"
gaggucauau

SEQ ID NO: 1989 - RNA, 10 nt, Unknown
  source: /note="Description of Unknown: Exemplary gene or splice site sequence"
gaggucaugu

SEQ ID NO: 1990 - RNA, 10 nt, Unknown
  source: /note="Description of Unknown: Exemplary gene or splice site sequence"
gaggucauuu

SEQ ID NO: 1991 - RNA, 10 nt, Unknown
  source: /note="Description of Unknown: Exemplary gene or splice site sequence"
gagguccaua

SEQ ID NO: 1992 - RNA, 10 nt, Unknown
  source: /note="Description of Unknown: Exemplary gene or splice site sequence"
gagguccauc

SEQ ID NO: 1993 - RNA, 10 nt, Unknown
  source: /note="Description of Unknown: Exemplary gene or splice site sequence"
gagguccggg

SEQ ID NO: 1994 - RNA, 10 nt, Unknown
  source: /note="Description of Unknown: Exemplary gene or splice site sequence"
gagguccggu

SEQ ID NO: 1995 - RNA, 10 nt, Unknown
  source: /note="Description of Unknown: Exemplary gene or splice site sequence"
gagguccuug

SEQ ID NO: 1996 - RNA, 10 nt, Unknown
  source: /note="Description of Unknown: Exemplary gene or splice site sequence"
gaggucgggg

SEQ ID NO: 1997 - RNA, 10 nt, Unknown
  source: /note="Description of Unknown: Exemplary gene or splice site sequence"
gaggucucgu

SEQ ID NO: 1998 - RNA, 10 nt, Unknown
  source: /note="Description of Unknown: Exemplary gene or splice site sequence"
gaggucugag

SEQ ID NO: 1999 - RNA, 10 nt, Unknown
  source: /note="Description of Unknown: Exemplary gene or splice site sequence"
gaggucuggu

SEQ ID NO: 2000 - RNA, 10 nt, Unknown
  source: /note="Description of Unknown: Exemplary gene or splice site sequence"
gaggucuguc

SEQ ID NO: 2001 - RNA, 10 nt, Unknown
  source: /note="Description of Unknown: Exemplary gene or splice site sequence"
gaggucuguu

SEQ ID NO: 2002 - RNA, 10 nt, Unknown
  source: /note="Description of Unknown: Exemplary gene or splice site sequence"
gaggucuuuu

SEQ ID NO: 2003 - RNA, 10 nt, Unknown
  source: /note="Description of Unknown: Exemplary gene or splice site sequence"
gaggugaaaa

SEQ ID NO: 2004 - RNA, 10 nt, Unknown
  source: /note="Description of Unknown: Exemplary gene or splice site sequence"
gaggugaaau

SEQ ID NO: 2005 - RNA, 10 nt, Unknown
  source: /note="Description of Unknown: Exemplary gene or splice site sequence"
gaggugaaca

SEQ ID NO: 2006 - RNA, 10 nt, Unknown
  source: /note="Description of Unknown: Exemplary gene or splice site sequence"
gaggugaagg

SEQ ID NO: 2007 - RNA, 10 nt, Unknown
  source: /note="Description of Unknown: Exemplary gene or splice site sequence"
gaggugaaua

SEQ ID NO: 2008 - RNA, 10 nt, Unknown
  source: /note="Description of Unknown: Exemplary gene or splice site sequence"
gaggugaauu

SEQ ID NO: 2009 - RNA, 10 nt, Unknown
  source: /note="Description of Unknown: Exemplary gene or splice site sequence"
gaggugacau

SEQ ID NO: 2010 - RNA, 10 nt, Unknown
  source: /note="Description of Unknown: Exemplary gene or splice site sequence"
gaggugacca

SEQ ID NO: 2011 - RNA, 10 nt, Unknown
  source: /note="Description of Unknown: Exemplary gene or splice site sequence"
gaggugaccu

SEQ ID NO: 2012 - RNA, 10 nt, Unknown
  source: /note="Description of Unknown: Exemplary gene or splice site sequence"
gaggugacua

SEQ ID NO: 2013 - RNA, 10 nt, Unknown
  source: /note="Description of Unknown: Exemplary gene or splice site sequence"
gaggugacuu

SEQ ID NO: 2014 - RNA, 10 nt, Unknown
  source: /note="Description of Unknown: Exemplary gene or splice site sequence"
gaggugagaa

SEQ ID NO: 2015 - RNA, 10 nt, Unknown
  source: /note="Description of Unknown: Exemplary gene or splice site sequence"
gaggugagac

SEQ ID NO: 2016 - RNA, 10 nt, Unknown
  source: /note="Description of Unknown: Exemplary gene or splice site sequence"
gaggugagag

SEQ ID NO: 2017 - RNA, 10 nt, Unknown
  source: /note="Description of Unknown: Exemplary gene or splice site sequence"
gaggugagau

SEQ ID NO: 2018 - RNA, 10 nt, Unknown
  source: /note="Description of Unknown: Exemplary gene or splice site sequence"
gaggugagca

SEQ ID NO: 2019 - RNA, 10 nt, Unknown
  source: /note="Description of Unknown: Exemplary gene or splice site sequence"
gaggugagcc

SEQ ID NO: 2020 - RNA, 10 nt, Unknown
  source: /note="Description of Unknown: Exemplary gene or splice site sequence"
gaggugagcg

SEQ ID NO: 2021 - RNA, 10 nt, Unknown
  source: /note="Description of Unknown: Exemplary gene or splice site sequence"
gaggugagcu

SEQ ID NO: 2022 - RNA, 10 nt, Unknown
  source: /note="Description of Unknown: Exemplary gene or splice site sequence"
gaggugagga

SEQ ID NO: 2023 - RNA, 10 nt, Unknown
  source: /note="Description of Unknown: Exemplary gene or splice site sequence"
gaggugaggc

SEQ ID NO: 2024 - RNA, 10 nt, Unknown
  source: /note="Description of Unknown: Exemplary gene or splice site sequence"
gaggugaggg

SEQ ID NO: 2025 - RNA, 10 nt, Unknown
  source: /note="Description of Unknown: Exemplary gene or splice site sequence"
gaggugagua

SEQ ID NO: 2026 - RNA, 10 nt, Unknown
  source: /note="Description of Unknown: Exemplary gene or splice site sequence"
gaggugagug

SEQ ID NO: 2027 - RNA, 10 nt, Unknown
  source: /note="Description of Unknown: Exemplary gene or splice site sequence"
gaggugaguu

SEQ ID NO: 2028 - RNA, 10 nt, Unknown
  source: /note="Description of Unknown: Exemplary gene or splice site sequence"
gaggugauau

SEQ ID NO: 2029 - RNA, 10 nt, Unknown
  source: /note="Description of Unknown: Exemplary gene or splice site sequence"
gaggugaucc

SEQ ID NO: 2030 - RNA, 10 nt, Unknown
  source: /note="Description of Unknown: Exemplary gene or splice site sequence"
gaggugaucu

SEQ ID NO: 2031 - RNA, 10 nt, Unknown
  source: /note="Description of Unknown: Exemplary gene or splice site sequence"
gaggugauga

SEQ ID NO: 2032 - RNA, 10 nt, Unknown
  source: /note="Description of Unknown: Exemplary gene or splice site sequence"
gaggugaugg

SEQ ID NO: 2033 - RNA, 10 nt, Unknown
  source: /note="Description of Unknown: Exemplary gene or splice site sequence"
gaggugaugu

SEQ ID NO: 2034 - RNA, 10 nt, Unknown
  source: /note="Description of Unknown: Exemplary gene or splice site sequence"
gaggugauuc

SEQ ID NO: 2035 - RNA, 10 nt, Unknown
  source: /note="Description of Unknown: Exemplary gene or splice site sequence"
gaggugcaca

SEQ ID NO: 2036 - RNA, 10 nt, Unknown
  source: /note="Description of Unknown: Exemplary gene or splice site sequence"
gaggugcaga

SEQ ID NO: 2037 - RNA, 10 nt, Unknown
  source: /note="Description of Unknown: Exemplary gene or splice site sequence"
gaggugcagc

SEQ ID NO: 2038 - RNA, 10 nt, Unknown
  source: /note="Description of Unknown: Exemplary gene or splice site sequence"
gaggugcagg

SEQ ID NO: 2039 - RNA, 10 nt, Unknown
  source: /note="Description of Unknown: Exemplary gene or splice site sequence"
gaggugccag

SEQ ID NO: 2040 - RNA, 10 nt, Unknown
  source: /note="Description of Unknown: Exemplary gene or splice site sequence"
gaggugccca

SEQ ID NO: 2041 - RNA, 10 nt, Unknown
  source: /note="Description of Unknown: Exemplary gene or splice site sequence"
gaggugccuu

SEQ ID NO: 2042 - RNA, 10 nt, Unknown
  source: /note="Description of Unknown: Exemplary gene or splice site sequence"
gaggugcggg

SEQ ID NO: 2043 - RNA, 10 nt, Unknown
  source: /note="Description of Unknown: Exemplary gene or splice site sequence"
gaggugcgug

SEQ ID NO: 2044 - RNA, 10 nt, Unknown
  source: /note="Description of Unknown: Exemplary gene or splice site sequence"
gaggugcucc

SEQ ID NO: 2045 - RNA, 10 nt, Unknown
  source: /note="Description of Unknown: Exemplary gene or splice site sequence"
gaggugcugg

SEQ ID NO: 2046 - RNA, 10 nt, Unknown
  source: /note="Description of Unknown: Exemplary gene or splice site sequence"
gaggugcuua

SEQ ID NO: 2047 - RNA, 10 nt, Unknown
  source: /note="Description of Unknown: Exemplary gene or splice site sequence"
gaggugcuug

SEQ ID NO: 2048 - RNA, 10 nt, Unknown
  source: /note="Description of Unknown: Exemplary gene or splice site sequence"
gagguggaaa

SEQ ID NO: 2049 - RNA, 10 nt, Unknown
  source: /note="Description of Unknown: Exemplary gene or splice site sequence"
gagguggaau

SEQ ID NO: 2050 - RNA, 10 nt, Unknown
  source: /note="Description of Unknown: Exemplary gene or splice site sequence"
gagguggacc

SEQ ID NO: 2051 - RNA, 10 nt, Unknown
  source: /note="Description of Unknown: Exemplary gene or splice site sequence"
gagguggacg

SEQ ID NO: 2052 - RNA, 10 nt, Unknown
  source: /note="Description of Unknown: Exemplary gene or splice site sequence"
gagguggagg

SEQ ID NO: 2053 - RNA, 10 nt, Unknown
  source: /note="Description of Unknown: Exemplary gene or splice site sequence"
gagguggcug

SEQ ID NO: 2054 - RNA, 10 nt, Unknown
  source: /note="Description of Unknown: Exemplary gene or splice site sequence"
gaggugggaa

SEQ ID NO: 2055 - RNA, 10 nt, Unknown
  source: /note="Description of Unknown: Exemplary gene or splice site sequence"
gaggugggag

SEQ ID NO: 2056 - RNA, 10 nt, Unknown
  source: /note="Description of Unknown: Exemplary gene or splice site sequence"
gaggugggau

SEQ ID NO: 2057 - RNA, 10 nt, Unknown
  source: /note="Description of Unknown: Exemplary gene or splice site sequence"
gaggugggca

SEQ ID NO: 2058 - RNA, 10 nt, Unknown
  source: /note="Description of Unknown: Exemplary gene or splice site sequence"
gaggugggcg

SEQ ID NO: 2059 - RNA, 10 nt, Unknown
  source: /note="Description of Unknown: Exemplary gene or splice site sequence"
gaggugggcu

SEQ ID NO: 2060 - RNA, 10 nt, Unknown
  source: /note="Description of Unknown: Exemplary gene or splice site sequence"
gaggugggga

SEQ ID NO: 2061 - RNA, 10 nt, Unknown
  source: /note="Description of Unknown: Exemplary gene or splice site sequence"
gagguggggc

SEQ ID NO: 2062 - RNA, 10 nt, Unknown
  source: /note="Description of Unknown: Exemplary gene or splice site sequence"
gagguggggg

SEQ ID NO: 2063 - RNA, 10 nt, Unknown
  source: /note="Description of Unknown: Exemplary gene or splice site sequence"
gaggugggua

SEQ ID NO: 2064 - RNA, 10 nt, Unknown
  source: /note="Description of Unknown: Exemplary gene or splice site sequence"
gagguggguc

SEQ ID NO: 2065 - RNA, 10 nt, Unknown
  source: /note="Description of Unknown: Exemplary gene or splice site sequence"
gaggugggug

SEQ ID NO: 2066 - RNA, 10 nt, Unknown
  source: /note="Description of Unknown: Exemplary gene or splice site sequence"
gagguggguu

SEQ ID NO: 2067 - RNA, 10 nt, Unknown
  source: /note="Description of Unknown: Exemplary gene or splice site sequence"
gaggugguau

SEQ ID NO: 2068 - RNA, 10 nt, Unknown
  source: /note="Description of Unknown: Exemplary gene or splice site sequence"
gaggugguuc

SEQ ID NO: 2069 - RNA, 10 nt, Unknown
  source: /note="Description of Unknown: Exemplary gene or splice site sequence"
gaggugucau

SEQ ID NO: 2070 - RNA, 10 nt, Unknown
  source: /note="Description of Unknown: Exemplary gene or splice site sequence"
gaggugugag

SEQ ID NO: 2071 - RNA, 10 nt, Unknown
  source: /note="Description of Unknown: Exemplary gene or splice site sequence"
gaggugugau

SEQ ID NO: 2072 - RNA, 10 nt, Unknown
  source: /note="Description of Unknown: Exemplary gene or splice site sequence"
gaggugugca

SEQ ID NO: 2073 - RNA, 10 nt, Unknown
  source: /note="Description of Unknown: Exemplary gene or splice site sequence"
gaggugugcu

SEQ ID NO: 2074 - RNA, 10 nt, Unknown
  source: /note="Description of Unknown: Exemplary gene or splice site sequence"
gaggugugga

SEQ ID NO: 2075 - RNA, 10 nt, Unknown
  source: /note="Description of Unknown: Exemplary gene or splice site sequence"
gagguguggg

SEQ ID NO: 2076 - RNA, 10 nt, Unknown
  source: /note="Description of Unknown: Exemplary gene or splice site sequence"
gagguguggu

SEQ ID NO: 2077 - RNA, 10 nt, Unknown
  source: /note="Description of Unknown: Exemplary gene or splice site sequence"
gaggugugua

SEQ ID NO: 2078 - RNA, 10 nt, Unknown
  source: /note="Description of Unknown: Exemplary gene or splice site sequence"
gaggugugug

SEQ ID NO: 2079 - RNA, 10 nt, Unknown
  source: /note="Description of Unknown: Exemplary gene or splice site sequence"
gagguuaaau

SEQ ID NO: 2080 - RNA, 10 nt, Unknown
  source: /note="Description of Unknown: Exemplary gene or splice site sequence"
gagguuaaga

SEQ ID NO: 2081 - RNA, 10 nt, Unknown
  source: /note="Description of Unknown: Exemplary gene or splice site sequence"
gagguuaaua

SEQ ID NO: 2082 - RNA, 10 nt, Unknown
  source: /note="Description of Unknown: Exemplary gene or splice site sequence"
gagguuaccg

SEQ ID NO: 2083 - RNA, 10 nt, Unknown
  source: /note="Description of Unknown: Exemplary gene or splice site sequence"
gagguuagaa

SEQ ID NO: 2084 - RNA, 10 nt, Unknown
  source: /note="Description of Unknown: Exemplary gene or splice site sequence"
gagguuagac

SEQ ID NO: 2085 - RNA, 10 nt, Unknown
  source: /note="Description of Unknown: Exemplary gene or splice site sequence"
gagguuagag

SEQ ID NO: 2086 - RNA, 10 nt, Unknown
  source: /note="Description of Unknown: Exemplary gene or splice site sequence"
gagguuaggu

SEQ ID NO: 2087 - RNA, 10 nt, Unknown
  source: /note="Description of Unknown: Exemplary gene or splice site sequence"
gagguuagua

SEQ ID NO: 2088 - RNA, 10 nt, Unknown
  source: /note="Description of Unknown: Exemplary gene or splice site sequence"
gagguuaguc

SEQ ID NO: 2089 - RNA, 10 nt, Unknown
  source: /note="Description of Unknown: Exemplary gene or splice site sequence"
gagguuagug

SEQ ID NO: 2090 - RNA, 10 nt, Unknown
  source: /note="Description of Unknown: Exemplary gene or splice site sequence"
gagguuaguu

SEQ ID NO: 2091 - RNA, 10 nt, Unknown
  source: /note="Description of Unknown: Exemplary gene or splice site sequence"
gagguuaugu

SEQ ID NO: 2092 - RNA, 10 nt, Unknown
  source: /note="Description of Unknown: Exemplary gene or splice site sequence"
gagguuauuc

SEQ ID NO: 2093 - RNA, 10 nt, Unknown
  source: /note="Description of Unknown: Exemplary gene or splice site sequence"
gagguucaaa

SEQ ID NO: 2094 - RNA, 10 nt, Unknown
  source: /note="Description of Unknown: Exemplary gene or splice site sequence"
gagguucaua

SEQ ID NO: 2095 - RNA, 10 nt, Unknown
  source: /note="Description of Unknown: Exemplary gene or splice site sequence"
gagguucuga

SEQ ID NO: 2096 - RNA, 10 nt, Unknown
  source: /note="Description of Unknown: Exemplary gene or splice site sequence"
gagguugaag

SEQ ID NO: 2097 - RNA, 10 nt, Unknown
  source: /note="Description of Unknown: Exemplary gene or splice site sequence"
gagguugcag

SEQ ID NO: 2098 - RNA, 10 nt, Unknown
  source: /note="Description of Unknown: Exemplary gene or splice site sequence"
gagguugcug

SEQ ID NO: 2099 - RNA, 10 nt, Unknown
  source: /note="Description of Unknown: Exemplary gene or splice site sequence"
gagguuggaa

SEQ ID NO: 2100 - RNA, 10 nt, Unknown
  source: /note="Description of Unknown: Exemplary gene or splice site sequence"
gagguuggag

SEQ ID NO: 2101 - RNA, 10 nt, Unknown
  source: /note="Description of Unknown: Exemplary gene or splice site sequence"
gagguuggau

SEQ ID NO: 2102 - RNA, 10 nt, Unknown
  source: /note="Description of Unknown: Exemplary gene or splice site sequence"
gagguuggua

SEQ ID NO: 2103 - RNA, 10 nt, Unknown
  source: /note="Description of Unknown: Exemplary gene or splice site sequence"
gagguugguc

SEQ ID NO: 2104 - RNA, 10 nt, Unknown
  source: /note="Description of Unknown: Exemplary gene or splice site sequence"
gagguugguu

SEQ ID NO: 2105 - RNA, 10 nt, Unknown
  source: /note="Description of Unknown: Exemplary gene or splice site sequence"
gagguuguag

SEQ ID NO: 2106 - RNA, 10 nt, Unknown
  source: /note="Description of Unknown: Exemplary gene or splice site sequence"
gagguuucug

SEQ ID NO: 2107 - RNA, 10 nt, Unknown
  source: /note="Description of Unknown: Exemplary gene or splice site sequence"
gagguuugag

SEQ ID NO: 2108 - RNA, 10 nt, Unknown
  source: /note="Description of Unknown: Exemplary gene or splice site sequence"
gagguuugga

SEQ ID NO: 2109 - RNA, 10 nt, Unknown
  source: /note="Description of Unknown: Exemplary gene or splice site sequence"
gagguuuggg

SEQ ID NO: 2110 - RNA, 10 nt, Unknown
  source: /note="Description of Unknown: Exemplary gene or splice site sequence"
gagguuugua

SEQ ID NO: 2111 - RNA, 10 nt, Unknown
  source: /note="Description of Unknown: Exemplary gene or splice site sequence"
gagguuuguu

SEQ ID NO: 2112 - RNA, 10 nt, Unknown
  source: /note="Description of Unknown: Exemplary gene or splice site sequence"
gagguuuuca

SEQ ID NO: 2113 - RNA, 10 nt, Unknown
  source: /note="Description of Unknown: Exemplary gene or splice site sequence"
gagguuuuga

SEQ ID NO: 2114 - RNA, 10 nt, Unknown
  source: /note="Description of Unknown: Exemplary gene or splice site sequence"
gagguuuugg

SEQ ID NO: 2115 - RNA, 10 nt, Unknown
  source: /note="Description of Unknown: Exemplary gene or splice site sequence"
gagguuuuua

SEQ ID NO: 2116 - RNA, 10 nt, Unknown
  source: /note="Description of Unknown: Exemplary gene or splice site sequence"
gagguuuuuc

SEQ ID NO: 2117 - RNA, 10 nt, Unknown
  source: /note="Description of Unknown: Exemplary gene or splice site sequence"
gauguaaaau

SEQ ID NO: 2118 - RNA, 10 nt, Unknown
  source: /note="Description of Unknown: Exemplary gene or splice site sequence"
gauguaagca

SEQ ID NO: 2119 - RNA, 10 nt, Unknown
  source: /note="Description of Unknown: Exemplary gene or splice site sequence"
gauguaagcc

SEQ ID NO: 2120 - RNA, 10 nt, Unknown
  source: /note="Description of Unknown: Exemplary gene or splice site sequence"
gauguaaggu

SEQ ID NO: 2121 - RNA, 10 nt, Unknown
  source: /note="Description of Unknown: Exemplary gene or splice site sequence"
gauguaagua

SEQ ID NO: 2122 - RNA, 10 nt, Unknown
  source: /note="Description of Unknown: Exemplary gene or splice site sequence"
gauguaagug

SEQ ID NO: 2123 - RNA, 10 nt, Unknown
  source: /note="Description of Unknown: Exemplary gene or splice site sequence"
gauguaaguu

SEQ ID NO: 2124 - RNA, 10 nt, Unknown
  source: /note="Description of Unknown: Exemplary gene or splice site sequence"
gauguacauc

SEQ ID NO: 2125 - RNA, 10 nt, Unknown
  source: /note="Description of Unknown: Exemplary gene or splice site sequence"
gauguaggua

SEQ ID NO: 2126 - RNA, 10 nt, Unknown
  source: /note="Description of Unknown: Exemplary gene or splice site sequence"
gauguauggc

SEQ ID NO: 2127 - RNA, 10 nt, Unknown
  source: /note="Description of Unknown: Exemplary gene or splice site sequence"
gauguaugua

SEQ ID NO: 2128 - RNA, 10 nt, Unknown
  source: /note="Description of Unknown: Exemplary gene or splice site sequence"
gauguauguu

SEQ ID NO: 2129 - RNA, 10 nt, Unknown
  source: /note="Description of Unknown: Exemplary gene or splice site sequence"
gaugucagug

SEQ ID NO: 2130 - RNA, 10 nt, Unknown
  source: /note="Description of Unknown: Exemplary gene or splice site sequence"
gaugugagag

SEQ ID NO: 2131 - RNA, 10 nt, Unknown
  source: /note="Description of Unknown: Exemplary gene or splice site sequence"
gaugugagcc

SEQ ID NO: 2132 - RNA, 10 nt, Unknown
  source: /note="Description of Unknown: Exemplary gene or splice site sequence"
gaugugagcu

SEQ ID NO: 2133 - RNA, 10 nt, Unknown
  source: /note="Description of Unknown: Exemplary gene or splice site sequence"
gaugugagga

SEQ ID NO: 2134 - RNA, 10 nt, Unknown
  source: /note="Description of Unknown: Exemplary gene or splice site sequence"
gaugugaguc

SEQ ID NO: 2135 - RNA, 10 nt, Unknown
  source: /note="Description of Unknown: Exemplary gene or splice site sequence"
gaugugagug

SEQ ID NO: 2136 - RNA, 10 nt, Unknown
  source: /note="Description of Unknown: Exemplary gene or splice site sequence"
gaugugaguu

SEQ ID NO: 2137 - RNA, 10 nt, Unknown
  source: /note="Description of Unknown: Exemplary gene or splice site sequence"
gaugugggua

SEQ ID NO: 2138 - RNA, 10 nt, Unknown
  source: /note="Description of Unknown: Exemplary gene or splice site sequence"
gaugugggug

SEQ ID NO: 2139 - RNA, 10 nt, Unknown
  source: /note="Description of Unknown: Exemplary gene or splice site sequence"
gauguguguu

SEQ ID NO: 2140 - RNA, 10 nt, Unknown
  source: /note="Description of Unknown: Exemplary gene or splice site sequence"
gauguuagcu

SEQ ID NO: 2141 - RNA, 10 nt, Unknown
  source: /note="Description of Unknown: Exemplary gene or splice site sequence"
gauguucagu

SEQ ID NO: 2142 - RNA, 10 nt, Unknown
  source: /note="Description of Unknown: Exemplary gene or splice site sequence"
gauguucgug

SEQ ID NO: 2143 - RNA, 10 nt, Unknown
  source: /note="Description of Unknown: Exemplary gene or splice site sequence"
gauguuuguu

SEQ ID NO: 2144 - RNA, 10 nt, Unknown
  source: /note="Description of Unknown: Exemplary gene or splice site sequence"
gcaguaaagg

SEQ ID NO: 2145 - RNA, 10 nt, Unknown
  source: /note="Description of Unknown: Exemplary gene or splice site sequence"
gcaguaagaa

SEQ ID NO: 2146 - RNA, 10 nt, Unknown
  source: /note="Description of Unknown: Exemplary gene or splice site sequence"
gcaguaagga

SEQ ID NO: 2147 - RNA, 10 nt, Unknown
  source: /note="Description of Unknown: Exemplary gene or splice site sequence"
gcaguaagua

SEQ ID NO: 2148 - RNA, 10 nt, Unknown
  source: /note="Description of Unknown: Exemplary gene or splice site sequence"
gcaguaaguc

SEQ ID NO: 2149 - RNA, 10 nt, Unknown
  source: /note="Description of Unknown: Exemplary gene or splice site sequence"
gcaguaaguu

SEQ ID NO: 2150 - RNA, 10 nt, Unknown
  source: /note="Description of Unknown: Exemplary gene or splice site sequence"
gcaguagaug

SEQ ID NO: 2151 - RNA, 10 nt, Unknown
  source: /note="Description of Unknown: Exemplary gene or splice site sequence"
gcaguaggua

SEQ ID NO: 2152 - RNA, 10 nt, Unknown
  source: /note="Description of Unknown: Exemplary gene or splice site sequence"
gcaguaugug

SEQ ID NO: 2153 - RNA, 10 nt, Unknown
  source: /note="Description of Unknown: Exemplary gene or splice site sequence"
gcaguauguu

SEQ ID NO: 2154 - RNA, 10 nt, Unknown
  source: /note="Description of Unknown: Exemplary gene or splice site sequence"
gcagucagua

SEQ ID NO: 2155 - RNA, 10 nt, Unknown
  source: /note="Description of Unknown: Exemplary gene or splice site sequence"
gcagucagug

SEQ ID NO: 2156 - RNA, 10 nt, Unknown
  source: /note="Description of Unknown: Exemplary gene or splice site sequence"
gcaguccggu

SEQ ID NO: 2157 - RNA, 10 nt, Unknown
  source: /note="Description of Unknown: Exemplary gene or splice site sequence"
gcagugacuu

SEQ ID NO: 2158 - RNA, 10 nt, Unknown
  source: /note="Description of Unknown: Exemplary gene or splice site sequence"
gcagugagcc

SEQ ID NO: 2159 - RNA, 10 nt, Unknown
  source: /note="Description of Unknown: Exemplary gene or splice site sequence"
gcagugagcg

SEQ ID NO: 2160 - RNA, 10 nt, Unknown
  source: /note="Description of Unknown: Exemplary gene or splice site sequence"
gcagugagcu

SEQ ID NO: 2161 - RNA, 10 nt, Unknown
  source: /note="Description of Unknown: Exemplary gene or splice site sequence"
gcagugagua

SEQ ID NO: 2162 - RNA, 10 nt, Unknown
  source: /note="Description of Unknown: Exemplary gene or splice site sequence"
gcagugagug

SEQ ID NO: 2163 - RNA, 10 nt, Unknown
  source: /note="Description of Unknown: Exemplary gene or splice site sequence"
gcagugaguu

SEQ ID NO: 2164 - RNA, 10 nt, Unknown
  source: /note="Description of Unknown: Exemplary gene or splice site sequence"
gcagugggua

SEQ ID NO: 2165 - RNA, 10 nt, Unknown
  source: /note="Description of Unknown: Exemplary gene or splice site sequence"
gcaguuaagu

SEQ ID NO: 2166 - RNA, 10 nt, Unknown
  source: /note="Description of Unknown: Exemplary gene or splice site sequence"
gcaguugagu

SEQ ID NO: 2167 - RNA, 10 nt, Unknown
  source: /note="Description of Unknown: Exemplary gene or splice site sequence"
gccguaaguc

SEQ ID NO: 2168 - RNA, 10 nt, Unknown
  source: /note="Description of Unknown: Exemplary gene or splice site sequence"
gccgugagua

SEQ ID NO: 2169 - RNA, 10 nt, Unknown
  source: /note="Description of Unknown: Exemplary gene or splice site sequence"
gcgguaaagc

SEQ ID NO: 2170 - RNA, 10 nt, Unknown
  source: /note="Description of Unknown: Exemplary gene or splice site sequence"
gcgguaaaua

SEQ ID NO: 2171 - RNA, 10 nt, Unknown
  source: /note="Description of Unknown: Exemplary gene or splice site sequence"
gcgguaagcu

SEQ ID NO: 2172 - RNA, 10 nt, Unknown
  source: /note="Description of Unknown: Exemplary gene or splice site sequence"
gcgguaaggg

SEQ ID NO: 2173 - RNA, 10 nt, Unknown
  source: /note="Description of Unknown: Exemplary gene or splice site sequence"
gcgguaagug

SEQ ID NO: 2174 - RNA, 10 nt, Unknown
  source: /note="Description of Unknown: Exemplary gene or splice site sequence"
gcgguaauca

SEQ ID NO: 2175 - RNA, 10 nt, Unknown
  source: /note="Description of Unknown: Exemplary gene or splice site sequence"
gcgguacgua

SEQ ID NO: 2176 - RNA, 10 nt, Unknown
  source: /note="Description of Unknown: Exemplary gene or splice site sequence"
gcgguacuug

SEQ ID NO: 2177 - RNA, 10 nt, Unknown
  source: /note="Description of Unknown: Exemplary gene or splice site sequence"
gcgguagggu

SEQ ID NO: 2178 - RNA, 10 nt, Unknown
  source: /note="Description of Unknown: Exemplary gene or splice site sequence"
gcgguagugu

SEQ ID NO: 2179 - RNA, 10 nt, Unknown
  source: /note="Description of Unknown: Exemplary gene or splice site sequence"
gcggugagca

SEQ ID NO: 2180 - RNA, 10 nt, Unknown
  source: /note="Description of Unknown: Exemplary gene or splice site sequence"
gcggugagcu

SEQ ID NO: 2181 - RNA, 10 nt, Unknown
  source: /note="Description of Unknown: Exemplary gene or splice site sequence"
gcggugaguu

SEQ ID NO: 2182 - RNA, 10 nt, Unknown
  source: /note="Description of Unknown: Exemplary gene or splice site sequence"
gcgguggcuc

SEQ ID NO: 2183 - RNA, 10 nt, Unknown
  source: /note="Description of Unknown: Exemplary gene or splice site sequence"
gcggugugca

SEQ ID NO: 2184 - RNA, 10 nt, Unknown
  source: /note="Description of Unknown: Exemplary gene or splice site sequence"
gcgguguguu

SEQ ID NO: 2185 - RNA, 10 nt, Unknown
  source: /note="Description of Unknown: Exemplary gene or splice site sequence"
gcgguuaagu

SEQ ID NO: 2186 - RNA, 10 nt, Unknown
  source: /note="Description of Unknown: Exemplary gene or splice site sequence"
gcgguuugca

SEQ ID NO: 2187 - RNA, 10 nt, Unknown
  source: /note="Description of Unknown: Exemplary gene or splice site sequence"
gcugcuguaa

SEQ ID NO: 2188 - RNA, 10 nt, Unknown
  source: /note="Description of Unknown: Exemplary gene or splice site sequence"
gcuguaaaua

SEQ ID NO: 2189 - RNA, 10 nt, Unknown
  source: /note="Description of Unknown: Exemplary gene or splice site sequence"
gcuguaagac

SEQ ID NO: 2190 - RNA, 10 nt, Unknown
  source: /note="Description of Unknown: Exemplary gene or splice site sequence"
gcuguaagag

SEQ ID NO: 2191 - RNA, 10 nt, Unknown
  source: /note="Description of Unknown: Exemplary gene or splice site sequence"
gcuguaagca

SEQ ID NO: 2192 - RNA, 10 nt, Unknown
  source: /note="Description of Unknown: Exemplary gene or splice site sequence"
gcuguaagga

SEQ ID NO: 2193 - RNA, 10 nt, Unknown
  source: /note="Description of Unknown: Exemplary gene or splice site sequence"
gcuguaagua

SEQ ID NO: 2194 - RNA, 10 nt, Unknown
  source: /note="Description of Unknown: Exemplary gene or splice site sequence"
gcuguaaguc

SEQ ID NO: 2195 - RNA, 10 nt, Unknown
  source: /note="Description of Unknown: Exemplary gene or splice site sequence"
gcuguaagug

SEQ ID NO: 2196 - RNA, 10 nt, Unknown
  source: /note="Description of Unknown: Exemplary gene or splice site sequence"
gcuguaaguu

SEQ ID NO: 2197 - RNA, 10 nt, Unknown
  source: /note="Description of Unknown: Exemplary gene or splice site sequence"
gcuguaggug

SEQ ID NO: 2198 - RNA, 10 nt, Unknown
  source: /note="Description of Unknown: Exemplary gene or splice site sequence"
gcuguauggu

SEQ ID NO: 2199 - RNA, 10 nt, Unknown
  source: /note="Description of Unknown: Exemplary gene or splice site sequence"
gcugucagug

SEQ ID NO: 2200 - RNA, 10 nt, Unknown
  source: /note="Description of Unknown: Exemplary gene or splice site sequence"
gcuguccuug

SEQ ID NO: 2201 - RNA, 10 nt, Unknown
  source: /note="Description of Unknown: Exemplary gene or splice site sequence"
gcugugagaa

SEQ ID NO: 2202 - RNA, 10 nt, Unknown
  source: /note="Description of Unknown: Exemplary gene or splice site sequence"
gcugugagcc

SEQ ID NO: 2203 - RNA, 10 nt, Unknown
  source: /note="Description of Unknown: Exemplary gene or splice site sequence"
gcugugagga

SEQ ID NO: 2204 - RNA, 10 nt, Unknown
  source: /note="Description of Unknown: Exemplary gene or splice site sequence"
gcugugagua

SEQ ID NO: 2205 - RNA, 10 nt, Unknown
  source: /note="Description of Unknown: Exemplary gene or splice site sequence"
gcugugaguc

SEQ ID NO: 2206 - RNA, 10 nt, Unknown
  source: /note="Description of Unknown: Exemplary gene or splice site sequence"
gcugugagug

SEQ ID NO: 2207 - RNA, 10 nt, Unknown
  source: /note="Description of Unknown: Exemplary gene or splice site sequence"
gcugugaguu

SEQ ID NO: 2208 - RNA, 10 nt, Unknown
  source: /note="Description of Unknown: Exemplary gene or splice site sequence"
gcuguggguu

SEQ ID NO: 2209 - RNA, 10 nt, Unknown
  source: /note="Description of Unknown: Exemplary gene or splice site sequence"
ggaguaagag

SEQ ID NO: 2210 - RNA, 10 nt, Unknown
  source: /note="Description of Unknown: Exemplary gene or splice site sequence"
ggaguaagca

SEQ ID NO: 2211 - RNA, 10 nt, Unknown
  source: /note="Description of Unknown: Exemplary gene or splice site sequence"
ggaguaagcc

SEQ ID NO: 2212 - RNA, 10 nt, Unknown
  source: /note="Description of Unknown: Exemplary gene or splice site sequence"
ggaguaagcu

SEQ ID NO: 2213 - RNA, 10 nt, Unknown
  source: /note="Description of Unknown: Exemplary gene or splice site sequence"
ggaguaagga

SEQ ID NO: 2214 - RNA, 10 nt, Unknown
  source: /note="Description of Unknown: Exemplary gene or splice site sequence"
ggaguaagug

SEQ ID NO: 2215 - RNA, 10 nt, Unknown
  source: /note="Description of Unknown: Exemplary gene or splice site sequence"
ggaguaaguu

SEQ ID NO: 2216 - RNA, 10 nt, Unknown
  source: /note="Description of Unknown: Exemplary gene or splice site sequence"
ggaguaauuu

SEQ ID NO: 2217 - RNA, 10 nt, Unknown
  source: /note="Description of Unknown: Exemplary gene or splice site sequence"
ggaguacugu

SEQ ID NO: 2218 - RNA, 10 nt, Unknown
  source: /note="Description of Unknown: Exemplary gene or splice site sequence"
ggaguaggaa

SEQ ID NO: 2219 - RNA, 10 nt, Unknown
  source: /note="Description of Unknown: Exemplary gene or splice site sequence"
ggaguaggua

SEQ ID NO: 2220 - RNA, 10 nt, Unknown
  source: /note="Description of Unknown: Exemplary gene or splice site sequence"
ggaguagguu

SEQ ID NO: 2221 - RNA, 10 nt, Unknown
  source: /note="Description of Unknown: Exemplary gene or splice site sequence"
ggaguaguau

SEQ ID NO: 2222 - RNA, 10 nt, Unknown
  source: /note="Description of Unknown: Exemplary gene or splice site sequence"
ggaguaugac

SEQ ID NO: 2223 - RNA, 10 nt, Unknown
  source: /note="Description of Unknown: Exemplary gene or splice site sequence"
ggaguauggu

SEQ ID NO: 2224 - RNA, 10 nt, Unknown
  source: /note="Description of Unknown: Exemplary gene or splice site sequence"
ggagucaagu

SEQ ID NO: 2225 - RNA, 10 nt, Unknown
  source: /note="Description of Unknown: Exemplary gene or splice site sequence"
ggagugaggg

SEQ ID NO: 2226 - RNA, 10 nt, Unknown
  source: /note="Description of Unknown: Exemplary gene or splice site sequence"
ggagugagua

SEQ ID NO: 2227 - RNA, 10 nt, Unknown
  source: /note="Description of Unknown: Exemplary gene or splice site sequence"
ggagugaguc

SEQ ID NO: 2228 - RNA, 10 nt, Unknown
  source: /note="Description of Unknown: Exemplary gene or splice site sequence"
ggagugagug

SEQ ID NO: 2229 - RNA, 10 nt, Unknown
  source: /note="Description of Unknown: Exemplary gene or splice site sequence"
ggagugaguu

SEQ ID NO: 2230 - RNA, 10 nt, Unknown
  source: /note="Description of Unknown: Exemplary gene or splice site sequence"
ggagugcuuu

SEQ ID NO: 2231 - RNA, 10 nt, Unknown
  source: /note="Description of Unknown: Exemplary gene or splice site sequence"
ggagugggca

SEQ ID NO: 2232 - RNA, 10 nt, Unknown
  source: /note="Description of Unknown: Exemplary gene or splice site sequence"
ggagugggug

SEQ ID NO: 2233 - RNA, 10 nt, Unknown
  source: /note="Description of Unknown: Exemplary gene or splice site sequence"
ggaguuaagg

SEQ ID NO: 2234 - RNA, 10 nt, Unknown
  source: /note="Description of Unknown: Exemplary gene or splice site sequence"
ggaguugaga

SEQ ID NO: 2235 - RNA, 10 nt, Unknown
  source: /note="Description of Unknown: Exemplary gene or splice site sequence"
ggcguaagcc

SEQ ID NO: 2236 - RNA, 10 nt, Unknown
  source: /note="Description of Unknown: Exemplary gene or splice site sequence"
ggcguaggua

SEQ ID NO: 2237 - RNA, 10 nt, Unknown
  source: /note="Description of Unknown: Exemplary gene or splice site sequence"
ggcguaggug

SEQ ID NO: 2238 - RNA, 10 nt, Unknown
  source: /note="Description of Unknown: Exemplary gene or splice site sequence"
ggcgugagcc

SEQ ID NO: 2239 - RNA, 10 nt, Unknown
  source: /note="Description of Unknown: Exemplary gene or splice site sequence"
ggcgugaguc

SEQ ID NO: 2240 - RNA, 10 nt, Unknown
  source: /note="Description of Unknown: Exemplary gene or splice site sequence"
gggguaaaca

SEQ ID NO: 2241 - RNA, 10 nt, Unknown
  source: /note="Description of Unknown: Exemplary gene or splice site sequence"
gggguaaacc

SEQ ID NO: 2242 - RNA, 10 nt, Unknown
  source: /note="Description of Unknown: Exemplary gene or splice site sequence"
gggguaaacu

SEQ ID NO: 2243 - RNA, 10 nt, Unknown
  source: /note="Description of Unknown: Exemplary gene or splice site sequence"
gggguaagaa

SEQ ID NO: 2244 - RNA, 10 nt, Unknown
  source: /note="Description of Unknown: Exemplary gene or splice site sequence"
gggguaagag

SEQ ID NO: 2245 - RNA, 10 nt, Unknown
  source: /note="Description of Unknown: Exemplary gene or splice site sequence"
gggguaagau

SEQ ID NO: 2246 - RNA, 10 nt, Unknown
  source: /note="Description of Unknown: Exemplary gene or splice site sequence"
gggguaagca

SEQ ID NO: 2247 - RNA, 10 nt, Unknown
  source: /note="Description of Unknown: Exemplary gene or splice site sequence"
gggguaagcc

SEQ ID NO: 2248 - RNA, 10 nt, Unknown
  source: /note="Description of Unknown: Exemplary gene or splice site sequence"
gggguaagcu

SEQ ID NO: 2249 - RNA, 10 nt, Unknown
  source: /note="Description of Unknown: Exemplary gene or splice site sequence"
gggguaagga

SEQ ID NO: 2250 - RNA, 10 nt, Unknown
  source: /note="Description of Unknown: Exemplary gene or splice site sequence"
gggguaaggg

SEQ ID NO: 2251 - RNA, 10 nt, Unknown
  source: /note="Description of Unknown: Exemplary gene or splice site sequence"
gggguaagua

SEQ ID NO: 2252 - RNA, 10 nt, Unknown
  source: /note="Description of Unknown: Exemplary gene or splice site sequence"
gggguaagug

SEQ ID NO: 2253 - RNA, 10 nt, Unknown
  source: /note="Description of Unknown: Exemplary gene or splice site sequence"
gggguaaguu

SEQ ID NO: 2254 - RNA, 10 nt, Unknown
  source: /note="Description of Unknown: Exemplary gene or splice site sequence"
gggguagaca

SEQ ID NO: 2255 - RNA, 10 nt, Unknown
  source: /note="Description of Unknown: Exemplary gene or splice site sequence"
gggguaggag

SEQ ID NO: 2256 - RNA, 10 nt, Unknown
  source: /note="Description of Unknown: Exemplary gene or splice site sequence"
gggguaggcc

SEQ ID NO: 2257 - RNA, 10 nt, Unknown
  source: /note="Description of Unknown: Exemplary gene or splice site sequence"
gggguaggga

SEQ ID NO: 2258 - RNA, 10 nt, Unknown
  source: /note="Description of Unknown: Exemplary gene or splice site sequence"
gggguaggua

SEQ ID NO: 2259 - RNA, 10 nt, Unknown
  source: /note="Description of Unknown: Exemplary gene or splice site sequence"
gggguaggug

SEQ ID NO: 2260 - RNA, 10 nt, Unknown
  source: /note="Description of Unknown: Exemplary gene or splice site sequence"
gggguagguu

SEQ ID NO: 2261 - RNA, 10 nt, Unknown
  source: /note="Description of Unknown: Exemplary gene or splice site sequence"
gggguagugc

SEQ ID NO: 2262 - RNA, 10 nt, Unknown
  source: /note="Description of Unknown: Exemplary gene or splice site sequence"
gggguaucug

SEQ ID NO: 2263 - RNA, 10 nt, Unknown
  source: /note="Description of Unknown: Exemplary gene or splice site sequence"
gggguaugac

SEQ ID NO: 2264 - RNA, 10 nt, Unknown
  source: /note="Description of Unknown: Exemplary gene or splice site sequence"
gggguaugga

SEQ ID NO: 2265 - RNA, 10 nt, Unknown
  source: /note="Description of Unknown: Exemplary gene or splice site sequence"
gggguaugua

SEQ ID NO: 2266 - RNA, 10 nt, Unknown
  source: /note="Description of Unknown: Exemplary gene or splice site sequence"
gggguauguc

SEQ ID NO: 2267 - RNA, 10 nt, Unknown
  source: /note="Description of Unknown: Exemplary gene or splice site sequence"
gggguaugug

SEQ ID NO: 2268 - RNA, 10 nt, Unknown
  source: /note="Description of Unknown: Exemplary gene or splice site sequence"
gggguauguu

SEQ ID NO: 2269 - RNA, 10 nt, Unknown
  source: /note="Description of Unknown: Exemplary gene or splice site sequence"
ggggucagua

SEQ ID NO: 2270 - RNA, 10 nt, Unknown
  source: /note="Description of Unknown: Exemplary gene or splice site sequence"
gggguccgug

SEQ ID NO: 2271 - RNA, 10 nt, Unknown
  source: /note="Description of Unknown: Exemplary gene or splice site sequence"
ggggucggag

SEQ ID NO: 2272 - RNA, 10 nt, Unknown
  source: /note="Description of Unknown: Exemplary gene or splice site sequence"
ggggucugug

SEQ ID NO: 2273 - RNA, 10 nt, Unknown
  source: /note="Description of Unknown: Exemplary gene or splice site sequence"
ggggugaaca

SEQ ID NO: 2274 - RNA, 10 nt, Unknown
  source: /note="Description of Unknown: Exemplary gene or splice site sequence"
ggggugaaga

SEQ ID NO: 2275 - RNA, 10 nt, Unknown
  source: /note="Description of Unknown: Exemplary gene or splice site sequence"
ggggugagaa

SEQ ID NO: 2276 - RNA, 10 nt, Unknown
  source: /note="Description of Unknown: Exemplary gene or splice site sequence"
ggggugagau

SEQ ID NO: 2277 - RNA, 10 nt, Unknown
  source: /note="Description of Unknown: Exemplary gene or splice site sequence"
ggggugagcc

SEQ ID NO: 2278 - RNA, 10 nt, Unknown
  source: /note="Description of Unknown: Exemplary gene or splice site sequence"
ggggugagcg

SEQ ID NO: 2279 - RNA, 10 nt, Unknown
  source: /note="Description of Unknown: Exemplary gene or splice site sequence"
ggggugagcu

SEQ ID NO: 2280 - RNA, 10 nt, Unknown
  source: /note="Description of Unknown: Exemplary gene or splice site sequence"
ggggugagga

SEQ ID NO: 2281 - RNA, 10 nt, Unknown
  source: /note="Description of Unknown: Exemplary gene or splice site sequence"
ggggugaggc

SEQ ID NO: 2282 - RNA, 10 nt, Unknown
  source: /note="Description of Unknown: Exemplary gene or splice site sequence"
ggggugaggg

SEQ ID NO: 2283 - RNA, 10 nt, Unknown
  source: /note="Description of Unknown: Exemplary gene or splice site sequence"
ggggugaguc

SEQ ID NO: 2284 - RNA, 10 nt, Unknown
  source: /note="Description of Unknown: Exemplary gene or splice site sequence"
ggggugagug

SEQ ID NO: 2285 - RNA, 10 nt, Unknown
  source: /note="Description of Unknown: Exemplary gene or splice site sequence"
ggggugaguu

SEQ ID NO: 2286 - RNA, 10 nt, Unknown
  source: /note="Description of Unknown: Exemplary gene or splice site sequence"
ggggugcgua

SEQ ID NO: 2287 - RNA, 10 nt, Unknown
  source: /note="Description of Unknown: Exemplary gene or splice site sequence"
gggguggggu

SEQ ID NO: 2288 - RNA, 10 nt, Unknown
  source: /note="Description of Unknown: Exemplary gene or splice site sequence"
ggggugggua

SEQ ID NO: 2289 - RNA, 10 nt, Unknown
  source: /note="Description of Unknown: Exemplary gene or splice site sequence"
ggggugggug

SEQ ID NO: 2290 - RNA, 10 nt, Unknown
  source: /note="Description of Unknown: Exemplary gene or splice site sequence"
gggguggguu

SEQ ID NO: 2291 - RNA, 10 nt, Unknown
  source: /note="Description of Unknown: Exemplary gene or splice site sequence"
ggggugugcg

SEQ ID NO: 2292 - RNA, 10 nt, Unknown
  source: /note="Description of Unknown: Exemplary gene or splice site sequence"
ggggugugua

SEQ ID NO: 2293 - RNA, 10 nt, Unknown
  source: /note="Description of Unknown: Exemplary gene or splice site sequence"
gggguguguc

SEQ ID NO: 2294 - RNA, 10 nt, Unknown
  source: /note="Description of Unknown: Exemplary gene or splice site sequence"
ggggugugug

SEQ ID NO: 2295 - RNA, 10 nt, Unknown
  source: /note="Description of Unknown: Exemplary gene or splice site sequence"
gggguuacag

SEQ ID NO: 2296 - RNA, 10 nt, Unknown
  source: /note="Description of Unknown: Exemplary gene or splice site sequence"
gggguuggac

SEQ ID NO: 2297 - RNA, 10 nt, Unknown
  source: /note="Description of Unknown: Exemplary gene or splice site sequence"
gggguuggga

SEQ ID NO: 2298 - RNA, 10 nt, Unknown
  source: /note="Description of Unknown: Exemplary gene or splice site sequence"
gggguuugcc

SEQ ID NO: 2299 - RNA, 10 nt, Unknown
  source: /note="Description of Unknown: Exemplary gene or splice site sequence"
gggguuugua

SEQ ID NO: 2300 - RNA, 10 nt, Unknown
  source: /note="Description of Unknown: Exemplary gene or splice site sequence"
gguguaagaa

SEQ ID NO: 2301 - RNA, 10 nt, Unknown
  source: /note="Description of Unknown: Exemplary gene or splice site sequence"
gguguaagau

SEQ ID NO: 2302 - RNA, 10 nt, Unknown
  source: /note="Description of Unknown: Exemplary gene or splice site sequence"
gguguaagca

SEQ ID NO: 2303 - RNA, 10 nt, Unknown
  source: /note="Description of Unknown: Exemplary gene or splice site sequence"
gguguaagcc

SEQ ID NO: 2304 - RNA, 10 nt, Unknown
  source: /note="Description of Unknown: Exemplary gene or splice site sequence"
gguguaagcg

SEQ ID NO: 2305 - RNA, 10 nt, Unknown
  source: /note="Description of Unknown: Exemplary gene or splice site sequence"
gguguaaguc

SEQ ID NO: 2306 - RNA, 10 nt, Unknown
  source: /note="Description of Unknown: Exemplary gene or splice site sequence"
gguguaagug

SEQ ID NO: 2307 - RNA, 10 nt, Unknown
  source: /note="Description of Unknown: Exemplary gene or splice site sequence"
gguguagguc

SEQ ID NO: 2308 - RNA, 10 nt, Unknown
  source: /note="Description of Unknown: Exemplary gene or splice site sequence"
gguguaggug

SEQ ID NO: 2309 - RNA, 10 nt, Unknown
  source: /note="Description of Unknown: Exemplary gene or splice site sequence"
gguguagguu

SEQ ID NO: 2310 - RNA, 10 nt, Unknown
  source: /note="Description of Unknown: Exemplary gene or splice site sequence"
gguguccgua

SEQ ID NO: 2311 - RNA, 10 nt, Unknown
  source: /note="Description of Unknown: Exemplary gene or splice site sequence"
ggugugagag

SEQ ID NO: 2312 - RNA, 10 nt, Unknown
  source: /note="Description of Unknown: Exemplary gene or splice site sequence"
ggugugagcc

SEQ ID NO: 2313 - RNA, 10 nt, Unknown
  source: /note="Description of Unknown: Exemplary gene or splice site sequence"
ggugugagcu

SEQ ID NO: 2314 - RNA, 10 nt, Unknown
  source: /note="Description of Unknown: Exemplary gene or splice site sequence"
ggugugagua

SEQ ID NO: 2315 - RNA, 10 nt, Unknown
  source: /note="Description of Unknown: Exemplary gene or splice site sequence"
ggugugaguc

SEQ ID NO: 2316 - RNA, 10 nt, Unknown
  source: /note="Description of Unknown: Exemplary gene or splice site sequence"
ggugugcuuc

SEQ ID NO: 2317 - RNA, 10 nt, Unknown
  source: /note="Description of Unknown: Exemplary gene or splice site sequence"
gguguggcug

SEQ ID NO: 2318 - RNA, 10 nt, Unknown
  source: /note="Description of Unknown: Exemplary gene or splice site sequence"
ggugugguga

SEQ ID NO: 2319 - RNA, 10 nt, Unknown
  source: /note="Description of Unknown: Exemplary gene or splice site sequence"
ggugugucug

SEQ ID NO: 2320 - RNA, 10 nt, Unknown
  source: /note="Description of Unknown: Exemplary gene or splice site sequence"
gguguugaaa

SEQ ID NO: 2321 - RNA, 10 nt, Unknown
  source: /note="Description of Unknown: Exemplary gene or splice site sequence"
gguguugcug

SEQ ID NO: 2322 - RNA, 10 nt, Unknown
  source: /note="Description of Unknown: Exemplary gene or splice site sequence"
guaguaagau

SEQ ID NO: 2323 - RNA, 10 nt, Unknown
  source: /note="Description of Unknown: Exemplary gene or splice site sequence"
guaguaagua

SEQ ID NO: 2324 - RNA, 10 nt, Unknown
  source: /note="Description of Unknown: Exemplary gene or splice site sequence"
guaguaagug

SEQ ID NO: 2325 - RNA, 10 nt, Unknown
  source: /note="Description of Unknown: Exemplary gene or splice site sequence"
guaguagcuu

SEQ ID NO: 2326 - RNA, 10 nt, Unknown
  source: /note="Description of Unknown: Exemplary gene or splice site sequence"
guaguaggua

SEQ ID NO: 2327 - RNA, 10 nt, Unknown
  source: /note="Description of Unknown: Exemplary gene or splice site sequence"
guagucagua

SEQ ID NO: 2328 - RNA, 10 nt, Unknown
  source: /note="Description of Unknown: Exemplary gene or splice site sequence"
guagugagua

SEQ ID NO: 2329 - RNA, 10 nt, Unknown
  source: /note="Description of Unknown: Exemplary gene or splice site sequence"
guaguggugg

SEQ ID NO: 2330 - RNA, 10 nt, Unknown
  source: /note="Description of Unknown: Exemplary gene or splice site sequence"
guaguuaagu

SEQ ID NO: 2331 - RNA, 10 nt, Unknown
  source: /note="Description of Unknown: Exemplary gene or splice site sequence"
guaguuucug

SEQ ID NO: 2332 - RNA, 10 nt, Unknown
  source: /note="Description of Unknown: Exemplary gene or splice site sequence"
gucguaagug

SEQ ID NO: 2333 - RNA, 10 nt, Unknown
  source: /note="Description of Unknown: Exemplary gene or splice site sequence"
gucgugagug

SEQ ID NO: 2334 - RNA, 10 nt, Unknown
  source: /note="Description of Unknown: Exemplary gene or splice site sequence"
gucgugaguu

SEQ ID NO: 2335 - RNA, 10 nt, Unknown
  source: /note="Description of Unknown: Exemplary gene or splice site sequence"
guggcaagua

SEQ ID NO: 2336 - RNA, 10 nt, Unknown
  source: /note="Description of Unknown: Exemplary gene or splice site sequence"
guggcuugua

SEQ ID NO: 2337 - RNA, 10 nt, Unknown
  source: /note="Description of Unknown: Exemplary gene or splice site sequence"
gugguaaaau

SEQ ID NO: 2338 - RNA, 10 nt, Unknown
  source: /note="Description of Unknown: Exemplary gene or splice site sequence"
gugguaaaga

SEQ ID NO: 2339 - RNA, 10 nt, Unknown
  source: /note="Description of Unknown: Exemplary gene or splice site sequence"
gugguaaauu

SEQ ID NO: 2340 - RNA, 10 nt, Unknown
  source: /note="Description of Unknown: Exemplary gene or splice site sequence"
gugguaacau

SEQ ID NO: 2341 - RNA, 10 nt, Unknown
  source: /note="Description of Unknown: Exemplary gene or splice site sequence"
gugguaacua

SEQ ID NO: 2342 - RNA, 10 nt, Unknown
  source: /note="Description of Unknown: Exemplary gene or splice site sequence"
gugguaagaa

SEQ ID NO: 2343 - RNA, 10 nt, Unknown
  source: /note="Description of Unknown: Exemplary gene or splice site sequence"
gugguaagac

SEQ ID NO: 2344 - RNA, 10 nt, Unknown
  source: /note="Description of Unknown: Exemplary gene or splice site sequence"
gugguaagag

SEQ ID NO: 2345 - RNA, 10 nt, Unknown
  source: /note="Description of Unknown: Exemplary gene or splice site sequence"
gugguaagau

SEQ ID NO: 2346 - RNA, 10 nt, Unknown
  source: /note="Description of Unknown: Exemplary gene or splice site sequence"
gugguaagca

SEQ ID NO: 2347 - RNA, 10 nt, Unknown
  source: /note="Description of Unknown: Exemplary gene or splice site sequence"
gugguaagcg

SEQ ID NO: 2348 - RNA, 10 nt, Unknown
  source: /note="Description of Unknown: Exemplary gene or splice site sequence"
gugguaagcu

SEQ ID NO: 2349 - RNA, 10 nt, Unknown
  source: /note="Description of Unknown: Exemplary gene or splice site sequence"
gugguaagga

SEQ ID NO: 2350 - RNA, 10 nt, Unknown
  source: /note="Description of Unknown: Exemplary gene or splice site sequence"
gugguaaggc

SEQ ID NO: 2351 - RNA, 10 nt, Unknown
  source: /note="Description of Unknown: Exemplary gene or splice site sequence"
gugguaagua

SEQ ID NO: 2352 - RNA, 10 nt, Unknown
  source: /note="Description of Unknown: Exemplary gene or splice site sequence"
gugguaaguc

SEQ ID NO: 2353 - RNA, 10 nt, Unknown
  source: /note="Description of Unknown: Exemplary gene or splice site sequence"
gugguaagug

SEQ ID NO: 2354 - RNA, 10 nt, Unknown
  source: /note="Description of Unknown: Exemplary gene or splice site sequence"
gugguaaguu

SEQ ID NO: 2355 - RNA, 10 nt, Unknown
  source: /note="Description of Unknown: Exemplary gene or splice site sequence"
gugguaauga

SEQ ID NO: 2356 - RNA, 10 nt, Unknown
  source: /note="Description of Unknown: Exemplary gene or splice site sequence"
gugguaauuc

SEQ ID NO: 2357 - RNA, 10 nt, Unknown
  source: /note="Description of Unknown: Exemplary gene or splice site sequence"
gugguaauuu

SEQ ID NO: 2358 - RNA, 10 nt, Unknown
  source: /note="Description of Unknown: Exemplary gene or splice site sequence"
gugguacaug

SEQ ID NO: 2359 - RNA, 10 nt, Unknown
  source: /note="Description of Unknown: Exemplary gene or splice site sequence"
gugguacgau

SEQ ID NO: 2360 - RNA, 10 nt, Unknown
  source: /note="Description of Unknown: Exemplary gene or splice site sequence"
gugguacuau

SEQ ID NO: 2361 - RNA, 10 nt, Unknown
  source: /note="Description of Unknown: Exemplary gene or splice site sequence"
gugguacuug

SEQ ID NO: 2362 - RNA, 10 nt, Unknown
  source: /note="Description of Unknown: Exemplary gene or splice site sequence"
gugguagaua

SEQ ID NO: 2363 - RNA, 10 nt, Unknown
  source: /note="Description of Unknown: Exemplary gene or splice site sequence"
gugguagcgc

SEQ ID NO: 2364 - RNA, 10 nt, Unknown
  source: /note="Description of Unknown: Exemplary gene or splice site sequence"
gugguaggga

SEQ ID NO: 2365 - RNA, 10 nt, Unknown
  source: /note="Description of Unknown: Exemplary gene or splice site sequence"
gugguagguc

SEQ ID NO: 2366 - RNA, 10 nt, Unknown
  source: /note="Description of Unknown: Exemplary gene or splice site sequence"
gugguaggug

SEQ ID NO: 2367 - RNA, 10 nt, Unknown
  source: /note="Description of Unknown: Exemplary gene or splice site sequence"
gugguagguu

SEQ ID NO: 2368 - RNA, 10 nt, Unknown
  source: /note="Description of Unknown: Exemplary gene or splice site sequence"
gugguauaaa

SEQ ID NO: 2369 - RNA, 10 nt, Unknown
  source: /note="Description of Unknown: Exemplary gene or splice site sequence"
gugguaucuc

SEQ ID NO: 2370 - RNA, 10 nt, Unknown
  source: /note="Description of Unknown: Exemplary gene or splice site sequence"
gugguaugaa

SEQ ID NO: 2371 - RNA, 10 nt, Unknown
  source: /note="Description of Unknown: Exemplary gene or splice site sequence"
gugguaugau

SEQ ID NO: 2372 - RNA, 10 nt, Unknown
  source: /note="Description of Unknown: Exemplary gene or splice site sequence"
gugguaugca

SEQ ID NO: 2373 - RNA, 10 nt, Unknown
  source: /note="Description of Unknown: Exemplary gene or splice site sequence"
gugguaugua

SEQ ID NO: 2374 - RNA, 10 nt, Unknown
  source: /note="Description of Unknown: Exemplary gene or splice site sequence"
gugguauguu

SEQ ID NO: 2375 - RNA, 10 nt, Unknown
  source: /note="Description of Unknown: Exemplary gene or splice site sequence"
gugguccgug

SEQ ID NO: 2376 - RNA, 10 nt, Unknown
  source: /note="Description of Unknown: Exemplary gene or splice site sequence"
guggucuggc

SEQ ID NO: 2377 - RNA, 10 nt, Unknown
  source: /note="Description of Unknown: Exemplary gene or splice site sequence"
guggugaaac

SEQ ID NO: 2378 - RNA, 10 nt, Unknown
  source: /note="Description of Unknown: Exemplary gene or splice site sequence"
guggugagaa

SEQ ID NO: 2379 - RNA, 10 nt, Unknown
  source: /note="Description of Unknown: Exemplary gene or splice site sequence"
guggugagau

SEQ ID NO: 2380 - RNA, 10 nt, Unknown
  source: /note="Description of Unknown: Exemplary gene or splice site sequence"
guggugagca

SEQ ID NO: 2381 - RNA, 10 nt, Unknown
  source: /note="Description of Unknown: Exemplary gene or splice site sequence"
guggugagcu

SEQ ID NO: 2382 - RNA, 10 nt, Unknown
  source: /note="Description of Unknown: Exemplary gene or splice site sequence"
guggugagga

SEQ ID NO: 2383 - RNA, 10 nt, Unknown
  source: /note="Description of Unknown: Exemplary gene or splice site sequence"
guggugaggc

SEQ ID NO: 2384 - RNA, 10 nt, Unknown
  source: /note="Description of Unknown: Exemplary gene or splice site sequence"
guggugagug

SEQ ID NO: 2385 - RNA, 10 nt, Unknown
  source: /note="Description of Unknown: Exemplary gene or splice site sequence"
guggugaguu

SEQ ID NO: 2386 - RNA, 10 nt, Unknown
  source: /note="Description of Unknown: Exemplary gene or splice site sequence"
guggugauua

SEQ ID NO: 2387 - RNA, 10 nt, Unknown
  source: /note="Description of Unknown: Exemplary gene or splice site sequence"
guggugauuc

SEQ ID NO: 2388 - RNA, 10 nt, Unknown
  source: /note="Description of Unknown: Exemplary gene or splice site sequence"
guggugcgau

SEQ ID NO: 2389 - RNA, 10 nt, Unknown
  source: /note="Description of Unknown: Exemplary gene or splice site sequence"
guggugcuua

SEQ ID NO: 2390 - RNA, 10 nt, Unknown
  source: /note="Description of Unknown: Exemplary gene or splice site sequence"
guggugggaa

SEQ ID NO: 2391 - RNA, 10 nt, Unknown
  source: /note="Description of Unknown: Exemplary gene or splice site sequence"
guggugggua

SEQ ID NO: 2392 - RNA, 10 nt, Unknown
  source: /note="Description of Unknown: Exemplary gene or splice site sequence"
gugguggguc

SEQ ID NO: 2393 - RNA, 10 nt, Unknown
  source: /note="Description of Unknown: Exemplary gene or splice site sequence"
gugguguccg

SEQ ID NO: 2394 - RNA, 10 nt, Unknown
  source: /note="Description of Unknown: Exemplary gene or splice site sequence"
gugguuagca

SEQ ID NO: 2395 - RNA, 10 nt, Unknown
  source: /note="Description of Unknown: Exemplary gene or splice site sequence"
gugguuaggu

SEQ ID NO: 2396 - RNA, 10 nt, Unknown
  source: /note="Description of Unknown: Exemplary gene or splice site sequence"
gugguuagug

SEQ ID NO: 2397 - RNA, 10 nt, Unknown
  source: /note="Description of Unknown: Exemplary gene or splice site sequence"
gugguuugca

SEQ ID NO: 2398 - RNA, 10 nt, Unknown
  source: /note="Description of Unknown: Exemplary gene or splice site sequence"
gugguuugua

SEQ ID NO: 2399 - RNA, 10 nt, Unknown
  source: /note="Description of Unknown: Exemplary gene or splice site sequence"
guuguaaggu

SEQ ID NO: 2400 - RNA, 10 nt, Unknown
  source: /note="Description of Unknown: Exemplary gene or splice site sequence"
guuguaagua

SEQ ID NO: 2401 - RNA, 10 nt, Unknown
  source: /note="Description of Unknown: Exemplary gene or splice site sequence"
guuguaaguc

SEQ ID NO: 2402 - RNA, 10 nt, Unknown
  source: /note="Description of Unknown: Exemplary gene or splice site sequence"
guuguaaguu

SEQ ID NO: 2403 - RNA, 10 nt, Unknown
  source: /note="Description of Unknown: Exemplary gene or splice site sequence"
guuguaccac

SEQ ID NO: 2404 - RNA, 10 nt, Unknown
  source: /note="Description of Unknown: Exemplary gene or splice site sequence"
guuguagcgu

SEQ ID NO: 2405 - RNA, 10 nt, Unknown
  source: /note="Description of Unknown: Exemplary gene or splice site sequence"
guuguaugug

SEQ ID NO: 2406 - RNA, 10 nt, Unknown
  source: /note="Description of Unknown: Exemplary gene or splice site sequence"
guuguauguu

SEQ ID NO: 2407 - RNA, 10 nt, Unknown
  source: /note="Description of Unknown: Exemplary gene or splice site sequence"
guugucugug

SEQ ID NO: 2408 - RNA, 10 nt, Unknown
  source: /note="Description of Unknown: Exemplary gene or splice site sequence"
guugugagcu

SEQ ID NO: 2409 - RNA, 10 nt, Unknown
  source: /note="Description of Unknown: Exemplary gene or splice site sequence"
guugugagug

SEQ ID NO: 2410 - RNA, 10 nt, Unknown
  source: /note="Description of Unknown: Exemplary gene or splice site sequence"
guugugaguu

SEQ ID NO: 2411 - RNA, 10 nt, Unknown
  source: /note="Description of Unknown: Exemplary gene or splice site sequence"
guugugggua

SEQ ID NO: 2412 - RNA, 10 nt, Unknown
  source: /note="Description of Unknown: Exemplary gene or splice site sequence"
guuguggguu

SEQ ID NO: 2413 - RNA, 10 nt, Unknown
  source: /note="Description of Unknown: Exemplary gene or splice site sequence"
uaaguaaaug

SEQ ID NO: 2414 - RNA, 10 nt, Unknown
  source: /note="Description of Unknown: Exemplary gene or splice site sequence"
uaaguaacua

SEQ ID NO: 2415 - RNA, 10 nt, Unknown
  source: /note="Description of Unknown: Exemplary gene or splice site sequence"
uaaguaagaa

SEQ ID NO: 2416 - RNA, 10 nt, Unknown
  source: /note="Description of Unknown: Exemplary gene or splice site sequence"
uaaguaagag

SEQ ID NO: 2417 - RNA, 10 nt, Unknown
  source: /note="Description of Unknown: Exemplary gene or splice site sequence"
uaaguaagau

SEQ ID NO: 2418 - RNA, 10 nt, Unknown
  source: /note="Description of Unknown: Exemplary gene or splice site sequence"
uaaguaagca

SEQ ID NO: 2419 - RNA, 10 nt, Unknown
  source: /note="Description of Unknown: Exemplary gene or splice site sequence"
uaaguaagcu

SEQ ID NO: 2420 - RNA, 10 nt, Unknown
  source: /note="Description of Unknown: Exemplary gene or splice site sequence"
uaaguaagga

SEQ ID NO: 2421 - RNA, 10 nt, Unknown
  source: /note="Description of Unknown: Exemplary gene or splice site sequence"
uaaguaaggu

SEQ ID NO: 2422 - RNA, 10 nt, Unknown
  source: /note="Description of Unknown: Exemplary gene or splice site sequence"
uaaguaagua

SEQ ID NO: 2423 - RNA, 10 nt, Unknown
  source: /note="Description of Unknown: Exemplary gene or splice site sequence"
uaaguaaguc

SEQ ID NO: 2424 - RNA, 10 nt, Unknown
  source: /note="Description of Unknown: Exemplary gene or splice site sequence"
uaaguaagug

SEQ ID NO: 2425 - RNA, 10 nt, Unknown
  source: /note="Description of Unknown: Exemplary gene or splice site sequence"
uaaguaaguu

SEQ ID NO: 2426 - RNA, 10 nt, Unknown
  source: /note="Description of Unknown: Exemplary gene or splice site sequence"
uaaguaauaa

SEQ ID NO: 2427 - RNA, 10 nt, Unknown
  source: /note="Description of Unknown: Exemplary gene or splice site sequence"
uaaguacuag

SEQ ID NO: 2428 - RNA, 10 nt, Unknown
  source: /note="Description of Unknown: Exemplary gene or splice site sequence"
uaaguaguuu

SEQ ID NO: 2429 - RNA, 10 nt, Unknown
  source: /note="Description of Unknown: Exemplary gene or splice site sequence"
uaaguauaaa

SEQ ID NO: 2430 - RNA, 10 nt, Unknown
  source: /note="Description of Unknown: Exemplary gene or splice site sequence"
uaaguauaca

SEQ ID NO: 2431 - RNA, 10 nt, Unknown
  source: /note="Description of Unknown: Exemplary gene or splice site sequence"
uaaguaugua

SEQ ID NO: 2432 - RNA, 10 nt, Unknown
  source: /note="Description of Unknown: Exemplary gene or splice site sequence"
uaaguauuau

SEQ ID NO: 2433 - RNA, 10 nt, Unknown
  source: /note="Description of Unknown: Exemplary gene or splice site sequence"
uaaguauuuu

SEQ ID NO: 2434 - RNA, 10 nt, Unknown
  source: /note="Description of Unknown: Exemplary gene or splice site sequence"
uaagucuuuu

SEQ ID NO: 2435 - RNA, 10 nt, Unknown
  source: /note="Description of Unknown: Exemplary gene or splice site sequence"
uaagugagac

SEQ ID NO: 2436 - RNA, 10 nt, Unknown
  source: /note="Description of Unknown: Exemplary gene or splice site sequence"
uaagugagga

SEQ ID NO: 2437 - RNA, 10 nt, Unknown
  source: /note="Description of Unknown: Exemplary gene or splice site sequence"
uaagugaggg

SEQ ID NO: 2438 - RNA, 10 nt, Unknown
  source: /note="Description of Unknown: Exemplary gene or splice site sequence"
uaagugagua

SEQ ID NO: 2439 - RNA, 10 nt, Unknown
  source: /note="Description of Unknown: Exemplary gene or splice site sequence"
uaagugaguc

SEQ ID NO: 2440 - RNA, 10 nt, Unknown
  source: /note="Description of Unknown: Exemplary gene or splice site sequence"
uaagugagug

SEQ ID NO: 2441 - RNA, 10 nt, Unknown
  source: /note="Description of Unknown: Exemplary gene or splice site sequence"
uaagugaguu

SEQ ID NO: 2442 - RNA, 10 nt, Unknown
  source: /note="Description of Unknown: Exemplary gene or splice site sequence"
uaagugaucc

SEQ ID NO: 2443 - RNA, 10 nt, Unknown
  source: /note="Description of Unknown: Exemplary gene or splice site sequence"
uaagugauuc

SEQ ID NO: 2444 - RNA, 10 nt, Unknown
  source: /note="Description of Unknown: Exemplary gene or splice site sequence"
uaagugcgug

SEQ ID NO: 2445 - RNA, 10 nt, Unknown
  source: /note="Description of Unknown: Exemplary gene or splice site sequence"
uaaguuaagu

SEQ ID NO: 2446 - RNA, 10 nt, Unknown
  source: /note="Description of Unknown: Exemplary gene or splice site sequence"
uaaguuccag

SEQ ID NO: 2447 - RNA, 10 nt, Unknown
  source: /note="Description of Unknown: Exemplary gene or splice site sequence"
uaaguucuuu

SEQ ID NO: 2448 - RNA, 10 nt, Unknown
  source: /note="Description of Unknown: Exemplary gene or splice site sequence"
uaaguuguaa

SEQ ID NO: 2449 - RNA, 10 nt, Unknown
  source: /note="Description of Unknown: Exemplary gene or splice site sequence"
uaaguuguau

SEQ ID NO: 2450 - RNA, 10 nt, Unknown
  source: /note="Description of Unknown: Exemplary gene or splice site sequence"
uaaguuuguu

SEQ ID NO: 2451 - RNA, 10 nt, Unknown
  source: /note="Description of Unknown: Exemplary gene or splice site sequence"
uacguaacug

SEQ ID NO: 2452 - RNA, 10 nt, Unknown
  source: /note="Description of Unknown: Exemplary gene or splice site sequence"
uacguaagaa

SEQ ID NO: 2453 - RNA, 10 nt, Unknown
  source: /note="Description of Unknown: Exemplary gene or splice site sequence"
uacguaagau

SEQ ID NO: 2454 - RNA, 10 nt, Unknown
  source: /note="Description of Unknown: Exemplary gene or splice site sequence"
uacguaagua

SEQ ID NO: 2455 - RNA, 10 nt, Unknown
  source: /note="Description of Unknown: Exemplary gene or splice site sequence"
uacguaagug

SEQ ID NO: 2456 - RNA, 10 nt, Unknown
  source: /note="Description of Unknown: Exemplary gene or splice site sequence"
uacguauccu

SEQ ID NO: 2457 - RNA, 10 nt, Unknown
  source: /note="Description of Unknown: Exemplary gene or splice site sequence"
uacgucuggc

SEQ ID NO: 2458 - RNA, 10 nt, Unknown
  source: /note="Description of Unknown: Exemplary gene or splice site sequence"
uacgugacca

SEQ ID NO: 2459 - RNA, 10 nt, Unknown
  source: /note="Description of Unknown: Exemplary gene or splice site sequence"
uaggcaagac

SEQ ID NO: 2460 - RNA, 10 nt, Unknown
  source: /note="Description of Unknown: Exemplary gene or splice site sequence"
uaggcaaguc

SEQ ID NO: 2461 - RNA, 10 nt, Unknown
  source: /note="Description of Unknown: Exemplary gene or splice site sequence"
uaggcagguc

SEQ ID NO: 2462 - RNA, 10 nt, Unknown
  source: /note="Description of Unknown: Exemplary gene or splice site sequence"
uaggcgugug

SEQ ID NO: 2463 - RNA, 10 nt, Unknown
  source: /note="Description of Unknown: Exemplary gene or splice site sequence"
uagguaaaaa

SEQ ID NO: 2464 - RNA, 10 nt, Unknown
  source: /note="Description of Unknown: Exemplary gene or splice site sequence"
uagguaaaac

SEQ ID NO: 2465 - RNA, 10 nt, Unknown
  source: /note="Description of Unknown: Exemplary gene or splice site sequence"
uagguaaaag

SEQ ID NO: 2466 - RNA, 10 nt, Unknown
  source: /note="Description of Unknown: Exemplary gene or splice site sequence"
uagguaaaau

SEQ ID NO: 2467 - RNA, 10 nt, Unknown
  source: /note="Description of Unknown: Exemplary gene or splice site sequence"
uagguaaaca

SEQ ID NO: 2468 - RNA, 10 nt, Unknown
  source: /note="Description of Unknown: Exemplary gene or splice site sequence"
uagguaaaga

SEQ ID NO: 2469 - RNA, 10 nt, Unknown
  source: /note="Description of Unknown: Exemplary gene or splice site sequence"
uagguaaaua

SEQ ID NO: 2470 - RNA, 10 nt, Unknown
  source: /note="Description of Unknown: Exemplary gene or splice site sequence"
uagguaaauc

SEQ ID NO: 2471 - RNA, 10 nt, Unknown
  source: /note="Description of Unknown: Exemplary gene or splice site sequence"
uagguaaaug

SEQ ID NO: 2472 - RNA, 10 nt, Unknown
  source: /note="Description of Unknown: Exemplary gene or splice site sequence"
uagguaaauu

SEQ ID NO: 2473 - RNA, 10 nt, Unknown
  source: /note="Description of Unknown: Exemplary gene or splice site sequence"
uagguaacac

SEQ ID NO: 2474 - RNA, 10 nt, Unknown
  source: /note="Description of Unknown: Exemplary gene or splice site sequence"
uagguaacag

SEQ ID NO: 2475 - RNA, 10 nt, Unknown
  source: /note="Description of Unknown: Exemplary gene or splice site sequence"
uagguaacau

SEQ ID NO: 2476 - RNA, 10 nt, Unknown
  source: /note="Description of Unknown: Exemplary gene or splice site sequence"
uagguaacca

SEQ ID NO: 2477 - RNA, 10 nt, Unknown
  source: /note="Description of Unknown: Exemplary gene or splice site sequence"
uagguaacgg

SEQ ID NO: 2478 - RNA, 10 nt, Unknown
  source: /note="Description of Unknown: Exemplary gene or splice site sequence"
uagguaacua

SEQ ID NO: 2479 - RNA, 10 nt, Unknown
  source: /note="Description of Unknown: Exemplary gene or splice site sequence"
uagguaacuc

SEQ ID NO: 2480 - RNA, 10 nt, Unknown
  source: /note="Description of Unknown: Exemplary gene or splice site sequence"
uagguaacug

SEQ ID NO: 2481 - RNA, 10 nt, Unknown
  source: /note="Description of Unknown: Exemplary gene or splice site sequence"
uagguaacuu

SEQ ID NO: 2482 - RNA, 10 nt, Unknown
  source: /note="Description of Unknown: Exemplary gene or splice site sequence"
uagguaagac

SEQ ID NO: 2483 - RNA, 10 nt, Unknown
  source: /note="Description of Unknown: Exemplary gene or splice site sequence"
uagguaagag

SEQ ID NO: 2484 - RNA, 10 nt, Unknown
  source: /note="Description of Unknown: Exemplary gene or splice site sequence"
uagguaagau

SEQ ID NO: 2485 - RNA, 10 nt, Unknown
  source: /note="Description of Unknown: Exemplary gene or splice site sequence"
uagguaagca

SEQ ID NO: 2486 - RNA, 10 nt, Unknown
  source: /note="Description of Unknown: Exemplary gene or splice site sequence"
uagguaagcc

SEQ ID NO: 2487 - RNA, 10 nt, Unknown
  source: /note="Description of Unknown: Exemplary gene or splice site sequence"
uagguaagcu

SEQ ID NO: 2488 - RNA, 10 nt, Unknown
  source: /note="Description of Unknown: Exemplary gene or splice site sequence"
uagguaagga

SEQ ID NO: 2489 - RNA, 10 nt, Unknown
  source: /note="Description of Unknown: Exemplary gene or splice site sequence"
uagguaaggc

SEQ ID NO: 2490 - RNA, 10 nt, Unknown
  source: /note="Description of Unknown: Exemplary gene or splice site sequence"
uagguaaggg

SEQ ID NO: 2491 - RNA, 10 nt, Unknown
  source: /note="Description of Unknown: Exemplary gene or splice site sequence"
uagguaagua

SEQ ID NO: 2492 - RNA, 10 nt, Unknown
  source: /note="Description of Unknown: Exemplary gene or splice site sequence"
uagguaaguc

SEQ ID NO: 2493 - RNA, 10 nt, Unknown
  source: /note="Description of Unknown: Exemplary gene or splice site sequence"
uagguaagug

SEQ ID NO: 2494 - RNA, 10 nt, Unknown
  source: /note="Description of Unknown: Exemplary gene or splice site sequence"
uagguaaguu

SEQ ID NO: 2495 - RNA, 10 nt, Unknown
  source: /note="Description of Unknown: Exemplary gene or splice site sequence"
uagguaauag

SEQ ID NO: 2496 - RNA, 10 nt, Unknown
  source: /note="Description of Unknown: Exemplary gene or splice site sequence"
uagguaauau

SEQ ID NO: 2497 - RNA, 10 nt, Unknown
  source: /note="Description of Unknown: Exemplary gene or splice site sequence"
uagguaaucu

SEQ ID NO: 2498 - RNA, 10 nt, Unknown
  source: /note="Description of Unknown: Exemplary gene or splice site sequence"
uagguaauga

SEQ ID NO: 2499 - RNA, 10 nt, Unknown
  source: /note="Description of Unknown: Exemplary gene or splice site sequence"
uagguaaugg

SEQ ID NO: 2500 - RNA, 10 nt, Unknown
  source: /note="Description of Unknown: Exemplary gene or splice site sequence"
uagguaaugu

SEQ ID NO: 2501 - RNA, 10 nt, Unknown
  source: /note="Description of Unknown: Exemplary gene or splice site sequence"
uagguaauua

SEQ ID NO: 2502 - RNA, 10 nt, Unknown
  source: /note="Description of Unknown: Exemplary gene or splice site sequence"
uagguaauuc

SEQ ID NO: 2503 - RNA, 10 nt, Unknown
  source: /note="Description of Unknown: Exemplary gene or splice site sequence"
uagguaauuu

SEQ ID NO: 2504 - RNA, 10 nt, Unknown
  source: /note="Description of Unknown: Exemplary gene or splice site sequence"
uagguacagc

SEQ ID NO: 2505 - RNA, 10 nt, Unknown
  source: /note="Description of Unknown: Exemplary gene or splice site sequence"
uagguacagu

SEQ ID NO: 2506 - RNA, 10 nt, Unknown
  source: /note="Description of Unknown: Exemplary gene or splice site sequence"
uagguacauu

SEQ ID NO: 2507 - RNA, 10 nt, Unknown
  source: /note="Description of Unknown: Exemplary gene or splice site sequence"
uagguaccag

SEQ ID NO: 2508 - RNA, 10 nt, Unknown
  source: /note="Description of Unknown: Exemplary gene or splice site sequence"
uagguaccua

SEQ ID NO: 2509 - RNA, 10 nt, Unknown
  source: /note="Description of Unknown: Exemplary gene or splice site sequence"
uagguaccuu

SEQ ID NO: 2510 - RNA, 10 nt, Unknown
  source: /note="Description of Unknown: Exemplary gene or splice site sequence"
uagguacgag

SEQ ID NO: 2511 - RNA, 10 nt, Unknown
  source: /note="Description of Unknown: Exemplary gene or splice site sequence"
uagguacgua

SEQ ID NO: 2512 - RNA, 10 nt, Unknown
  source: /note="Description of Unknown: Exemplary gene or splice site sequence"
uagguacguu

SEQ ID NO: 2513 - RNA, 10 nt, Unknown
  source: /note="Description of Unknown: Exemplary gene or splice site sequence"
uagguacuau

SEQ ID NO: 2514 - RNA, 10 nt, Unknown
  source: /note="Description of Unknown: Exemplary gene or splice site sequence"
uagguacuga

SEQ ID NO: 2515 - RNA, 10 nt, Unknown
  source: /note="Description of Unknown: Exemplary gene or splice site sequence"
uagguacugg

SEQ ID NO: 2516 - RNA, 10 nt, Unknown
  source: /note="Description of Unknown: Exemplary gene or splice site sequence"
uagguacuuc

SEQ ID NO: 2517 - RNA, 10 nt, Unknown
  source: /note="Description of Unknown: Exemplary gene or splice site sequence"
uagguacuuu

SEQ ID NO: 2518 - RNA, 10 nt, Unknown
  source: /note="Description of Unknown: Exemplary gene or splice site sequence"
uagguagcgg

SEQ ID NO: 2519 - RNA, 10 nt, Unknown
  source: /note="Description of Unknown: Exemplary gene or splice site sequence"
uagguaggaa

SEQ ID NO: 2520 - RNA, 10 nt, Unknown
  source: /note="Description of Unknown: Exemplary gene or splice site sequence"
uagguaggac

SEQ ID NO: 2521 - RNA, 10 nt, Unknown
  source: /note="Description of Unknown: Exemplary gene or splice site sequence"
uagguaggau

SEQ ID NO: 2522 - RNA, 10 nt, Unknown
  source: /note="Description of Unknown: Exemplary gene or splice site sequence"
uagguaggga

SEQ ID NO: 2523 - RNA, 10 nt, Unknown
  source: /note="Description of Unknown: Exemplary gene or splice site sequence"
uagguagggg

SEQ ID NO: 2524 - RNA, 10 nt, Unknown
  source: /note="Description of Unknown: Exemplary gene or splice site sequence"
uagguaggua

SEQ ID NO: 2525 - RNA, 10 nt, Unknown
  source: /note="Description of Unknown: Exemplary gene or splice site sequence"
uagguagguc

SEQ ID NO: 2526 - RNA, 10 nt, Unknown
  source: /note="Description of Unknown: Exemplary gene or splice site sequence"
uagguaggug

SEQ ID NO: 2527 - RNA, 10 nt, Unknown
  source: /note="Description of Unknown: Exemplary gene or splice site sequence"
uagguagguu

SEQ ID NO: 2528 - RNA, 10 nt, Unknown
  source: /note="Description of Unknown: Exemplary gene or splice site sequence"
uagguaguaa

SEQ ID NO: 2529 - RNA, 10 nt, Unknown
  source: /note="Description of Unknown: Exemplary gene or splice site sequence"
uagguagucu

SEQ ID NO: 2530 - RNA, 10 nt, Unknown
  source: /note="Description of Unknown: Exemplary gene or splice site sequence"
uagguagugg

SEQ ID NO: 2531 - RNA, 10 nt, Unknown
  source: /note="Description of Unknown: Exemplary gene or splice site sequence"
uagguagugu

SEQ ID NO: 2532 - RNA, 10 nt, Unknown
  source: /note="Description of Unknown: Exemplary gene or splice site sequence"
uagguaguuu

SEQ ID NO: 2533 - RNA, 10 nt, Unknown
  source: /note="Description of Unknown: Exemplary gene or splice site sequence"
uagguauaaa

SEQ ID NO: 2534 - RNA, 10 nt, Unknown
  source: /note="Description of Unknown: Exemplary gene or splice site sequence"
uagguauaac

SEQ ID NO: 2535 - RNA, 10 nt, Unknown
  source: /note="Description of Unknown: Exemplary gene or splice site sequence"
uagguauaag

SEQ ID NO: 2536 - RNA, 10 nt, Unknown
  source: /note="Description of Unknown: Exemplary gene or splice site sequence"
uagguauaau

SEQ ID NO: 2537 - RNA, 10 nt, Unknown
  source: /note="Description of Unknown: Exemplary gene or splice site sequence"
uagguauaca

SEQ ID NO: 2538 - RNA, 10 nt, Unknown
  source: /note="Description of Unknown: Exemplary gene or splice site sequence"
uagguauacu

SEQ ID NO: 2539 - RNA, 10 nt, Unknown
  source: /note="Description of Unknown: Exemplary gene or splice site sequence"
uagguauaua

SEQ ID NO: 2540 - RNA, 10 nt, Unknown
  source: /note="Description of Unknown: Exemplary gene or splice site sequence"
uagguauauc

SEQ ID NO: 2541 - RNA, 10 nt, Unknown
  source: /note="Description of Unknown: Exemplary gene or splice site sequence"
uagguauauu

SEQ ID NO: 2542 - RNA, 10 nt, Unknown
  source: /note="Description of Unknown: Exemplary gene or splice site sequence"
uagguaucag

SEQ ID NO: 2543 - RNA, 10 nt, Unknown
  source: /note="Description of Unknown: Exemplary gene or splice site sequence"
uagguaucua

SEQ ID NO: 2544 - RNA, 10 nt, Unknown
  source: /note="Description of Unknown: Exemplary gene or splice site sequence"
uagguaucuc

SEQ ID NO: 2545 - RNA, 10 nt, Unknown
  source: /note="Description of Unknown: Exemplary gene or splice site sequence"
uagguaugaa

SEQ ID NO: 2546 - RNA, 10 nt, Unknown
  source: /note="Description of Unknown: Exemplary gene or splice site sequence"
uagguaugag

SEQ ID NO: 2547 - RNA, 10 nt, Unknown
  source: /note="Description of Unknown: Exemplary gene or splice site sequence"
uagguaugca

SEQ ID NO: 2548 - RNA, 10 nt, Unknown
  source: /note="Description of Unknown: Exemplary gene or splice site sequence"
uagguaugga

SEQ ID NO: 2549 - RNA, 10 nt, Unknown
  source: /note="Description of Unknown: Exemplary gene or splice site sequence"
uagguauggc

SEQ ID NO: 2550 - RNA, 10 nt, Unknown
  source: /note="Description of Unknown: Exemplary gene or splice site sequence"
uagguauggu

SEQ ID NO: 2551 - RNA, 10 nt, Unknown
  source: /note="Description of Unknown: Exemplary gene or splice site sequence"
uagguaugua

SEQ ID NO: 2552 - RNA, 10 nt, Unknown
  source: /note="Description of Unknown: Exemplary gene or splice site sequence"
uagguauguc

SEQ ID NO: 2553 - RNA, 10 nt, Unknown
  source: /note="Description of Unknown: Exemplary gene or splice site sequence"
uagguaugug

SEQ ID NO: 2554 - RNA, 10 nt, Unknown
  source: /note="Description of Unknown: Exemplary gene or splice site sequence"
uagguauguu

SEQ ID NO: 2555 - RNA, 10 nt, Unknown
  source: /note="Description of Unknown: Exemplary gene or splice site sequence"
uagguauuaa

SEQ ID NO: 2556 - RNA, 10 nt, Unknown
  source: /note="Description of Unknown: Exemplary gene or splice site sequence"
uagguauuac

SEQ ID NO: 2557 - RNA, 10 nt, Unknown
  source: /note="Description of Unknown: Exemplary gene or splice site sequence"
uagguauuau

SEQ ID NO: 2558 - RNA, 10 nt, Unknown
  source: /note="Description of Unknown: Exemplary gene or splice site sequence"
uagguauuca

SEQ ID NO: 2559 - RNA, 10 nt, Unknown
  source: /note="Description of Unknown: Exemplary gene or splice site sequence"
uagguauucc

SEQ ID NO: 2560 - RNA, 10 nt, Unknown
  source: /note="Description of Unknown: Exemplary gene or splice site sequence"
uagguauucu

SEQ ID NO: 2561 - RNA, 10 nt, Unknown
  source: /note="Description of Unknown: Exemplary gene or splice site sequence"
uagguauuga

SEQ ID NO: 2562 - RNA, 10 nt, Unknown
  source: /note="Description of Unknown: Exemplary gene or splice site sequence"
uagguauuua

SEQ ID NO: 2563 - RNA, 10 nt, Unknown
  source: /note="Description of Unknown: Exemplary gene or splice site sequence"
uagguauuuc

SEQ ID NO: 2564 - RNA, 10 nt, Unknown
  source: /note="Description of Unknown: Exemplary gene or splice site sequence"
uagguauuuu

SEQ ID NO: 2565 - RNA, 10 nt, Unknown
  source: /note="Description of Unknown: Exemplary gene or splice site sequence"
uaggucacuc

SEQ ID NO: 2566 - RNA, 10 nt, Unknown
  source: /note="Description of Unknown: Exemplary gene or splice site sequence"
uaggucagcu

SEQ ID NO: 2567 - RNA, 10 nt, Unknown
  source: /note="Description of Unknown: Exemplary gene or splice site sequence"
uaggucaggu

SEQ ID NO: 2568 - RNA, 10 nt, Unknown
  source: /note="Description of Unknown: Exemplary gene or splice site sequence"
uaggucagua

SEQ ID NO: 2569 - RNA, 10 nt, Unknown
  source: /note="Description of Unknown: Exemplary gene or splice site sequence"
uaggucagug

SEQ ID NO: 2570 - RNA, 10 nt, Unknown
  source: /note="Description of Unknown: Exemplary gene or splice site sequence"
uaggucaguu

SEQ ID NO: 2571 - RNA, 10 nt, Unknown
  source: /note="Description of Unknown: Exemplary gene or splice site sequence"
uaggucaucu

SEQ ID NO: 2572 - RNA, 10 nt, Unknown
  source: /note="Description of Unknown: Exemplary gene or splice site sequence"
uaggucauug

SEQ ID NO: 2573 - RNA, 10 nt, Unknown
  source: /note="Description of Unknown: Exemplary gene or splice site sequence"
uagguccaau

SEQ ID NO: 2574 - RNA, 10 nt, Unknown
  source: /note="Description of Unknown: Exemplary gene or splice site sequence"
uagguccugu

SEQ ID NO: 2575 - RNA, 10 nt, Unknown
  source: /note="Description of Unknown: Exemplary gene or splice site sequence"
uaggucucaa

SEQ ID NO: 2576 - RNA, 10 nt, Unknown
  source: /note="Description of Unknown: Exemplary gene or splice site sequence"
uaggucucgc

SEQ ID NO: 2577 - RNA, 10 nt, Unknown
  source: /note="Description of Unknown: Exemplary gene or splice site sequence"
uaggucuggc

SEQ ID NO: 2578 - RNA, 10 nt, Unknown
  source: /note="Description of Unknown: Exemplary gene or splice site sequence"
uaggucuguc

SEQ ID NO: 2579 - RNA, 10 nt, Unknown
  source: /note="Description of Unknown: Exemplary gene or splice site sequence"
uaggucugug

SEQ ID NO: 2580 - RNA, 10 nt, Unknown
  source: /note="Description of Unknown: Exemplary gene or splice site sequence"
uaggugaagu

SEQ ID NO: 2581 - RNA, 10 nt, Unknown
  source: /note="Description of Unknown: Exemplary gene or splice site sequence"
uaggugaaua

SEQ ID NO: 2582 - RNA, 10 nt, Unknown
  source: /note="Description of Unknown: Exemplary gene or splice site sequence"
uaggugaaug

SEQ ID NO: 2583 - RNA, 10 nt, Unknown
  source: /note="Description of Unknown: Exemplary gene or splice site sequence"
uaggugaauu

SEQ ID NO: 2584 - RNA, 10 nt, Unknown
  source: /note="Description of Unknown: Exemplary gene or splice site sequence"
uaggugacau

SEQ ID NO: 2585 - RNA, 10 nt, Unknown
  source: /note="Description of Unknown: Exemplary gene or splice site sequence"
uaggugacca

SEQ ID NO: 2586 - RNA, 10 nt, Unknown
  source: /note="Description of Unknown: Exemplary gene or splice site sequence"
uaggugacua

SEQ ID NO: 2587 - RNA, 10 nt, Unknown
  source: /note="Description of Unknown: Exemplary gene or splice site sequence"
uaggugagaa

SEQ ID NO: 2588 - RNA, 10 nt, Unknown
  source: /note="Description of Unknown: Exemplary gene or splice site sequence"
uaggugagac

SEQ ID NO: 2589 - RNA, 10 nt, Unknown
  source: /note="Description of Unknown: Exemplary gene or splice site sequence"
uaggugagag

SEQ ID NO: 2590 - RNA, 10 nt, Unknown
  source: /note="Description of Unknown: Exemplary gene or splice site sequence"
uaggugagau

SEQ ID NO: 2591 - RNA, 10 nt, Unknown
  source: /note="Description of Unknown: Exemplary gene or splice site sequence"
uaggugagcc

SEQ ID NO: 2592 - RNA, 10 nt, Unknown
  source: /note="Description of Unknown: Exemplary gene or splice site sequence"
uaggugagcu

SEQ ID NO: 2593 - RNA, 10 nt, Unknown
  source: /note="Description of Unknown: Exemplary gene or splice site sequence"
uaggugagga

SEQ ID NO: 2594 - RNA, 10 nt, Unknown
  source: /note="Description of Unknown: Exemplary gene or splice site sequence"
uaggugaggc

SEQ ID NO: 2595 - RNA, 10 nt, Unknown
  source: /note="Description of Unknown: Exemplary gene or splice site sequence"
uaggugaggu

SEQ ID NO: 2596 - RNA, 10 nt, Unknown
  source: /note="Description of Unknown: Exemplary gene or splice site sequence"
uaggugagua

SEQ ID NO: 2597 - RNA, 10 nt, Unknown
  source: /note="Description of Unknown: Exemplary gene or splice site sequence"
uaggugaguc

SEQ ID NO: 2598 - RNA, 10 nt, Unknown
  source: /note="Description of Unknown: Exemplary gene or splice site sequence"
uaggugagug

SEQ ID NO: 2599 - RNA, 10 nt, Unknown
  source: /note="Description of Unknown: Exemplary gene or splice site sequence"
uaggugauca

SEQ ID NO: 2600 - RNA, 10 nt, Unknown
  source: /note="Description of Unknown: Exemplary gene or splice site sequence"
uaggugauuc

SEQ ID NO: 2601 - RNA, 10 nt, Unknown
  source: /note="Description of Unknown: Exemplary gene or splice site sequence"
uaggugauuu

SEQ ID NO: 2602 - RNA, 10 nt, Unknown
  source: /note="Description of Unknown: Exemplary gene or splice site sequence"
uaggugcaua

SEQ ID NO: 2603 - RNA, 10 nt, Unknown
  source: /note="Description of Unknown: Exemplary gene or splice site sequence"
uaggugcauc

SEQ ID NO: 2604 - RNA, 10 nt, Unknown
  source: /note="Description of Unknown: Exemplary gene or splice site sequence"
uaggugccgu

SEQ ID NO: 2605 - RNA, 10 nt, Unknown
  source: /note="Description of Unknown: Exemplary gene or splice site sequence"
uaggugccug

SEQ ID NO: 2606 - RNA, 10 nt, Unknown
  source: /note="Description of Unknown: Exemplary gene or splice site sequence"
uaggugcgca

SEQ ID NO: 2607 - RNA, 10 nt, Unknown
  source: /note="Description of Unknown: Exemplary gene or splice site sequence"
uaggugcgua

SEQ ID NO: 2608 - RNA, 10 nt, Unknown
  source: /note="Description of Unknown: Exemplary gene or splice site sequence"
uaggugcgug

SEQ ID NO: 2609 - RNA, 10 nt, Unknown
  source: /note="Description of Unknown: Exemplary gene or splice site sequence"
uaggugcuga

SEQ ID NO: 2610 - RNA, 10 nt, Unknown
  source: /note="Description of Unknown: Exemplary gene or splice site sequence"
uagguggaua

SEQ ID NO: 2611 - RNA, 10 nt, Unknown
  source: /note="Description of Unknown: Exemplary gene or splice site sequence"
uaggugggaa

SEQ ID NO: 2612 - RNA, 10 nt, Unknown
  source: /note="Description of Unknown: Exemplary gene or splice site sequence"
uaggugggac

SEQ ID NO: 2613 - RNA, 10 nt, Unknown
  source: /note="Description of Unknown: Exemplary gene or splice site sequence"
uaggugggag

SEQ ID NO: 2614 - RNA, 10 nt, Unknown
  source: /note="Description of Unknown: Exemplary gene or splice site sequence"
uaggugggau

SEQ ID NO: 2615 - RNA, 10 nt, Unknown
  source: /note="Description of Unknown: Exemplary gene or splice site sequence"
uaggugggcc

SEQ ID NO: 2616 - RNA, 10 nt, Unknown
  source: /note="Description of Unknown: Exemplary gene or splice site sequence"
uaggugggcu

SEQ ID NO: 2617 - RNA, 10 nt, Unknown
  source: /note="Description of Unknown: Exemplary gene or splice site sequence"
uagguggguu

SEQ ID NO: 2618 - RNA, 10 nt, Unknown
  source: /note="Description of Unknown: Exemplary gene or splice site sequence"
uagguggugu

SEQ ID NO: 2619 - RNA, 10 nt, Unknown
  source: /note="Description of Unknown: Exemplary gene or splice site sequence"
uagguguaaa

SEQ ID NO: 2620 - RNA, 10 nt, Unknown
  source: /note="Description of Unknown: Exemplary gene or splice site sequence"
uaggugugaa

SEQ ID NO: 2621 - RNA, 10 nt, Unknown
  source: /note="Description of Unknown: Exemplary gene or splice site sequence"
uaggugugag

SEQ ID NO: 2622 - RNA, 10 nt, Unknown
  source: /note="Description of Unknown: Exemplary gene or splice site sequence"
uaggugugca

SEQ ID NO: 2623 - RNA, 10 nt, Unknown
  source: /note="Description of Unknown: Exemplary gene or splice site sequence"
uaggugugcc

SEQ ID NO: 2624 - RNA, 10 nt, Unknown
  source: /note="Description of Unknown: Exemplary gene or splice site sequence"
uaggugugcg

SEQ ID NO: 2625 - RNA, 10 nt, Unknown
  source: /note="Description of Unknown: Exemplary gene or splice site sequence"
uagguguggu

SEQ ID NO: 2626 - RNA, 10 nt, Unknown
  source: /note="Description of Unknown: Exemplary gene or splice site sequence"
uaggugugua

SEQ ID NO: 2627 - RNA, 10 nt, Unknown
  source: /note="Description of Unknown: Exemplary gene or splice site sequence"
uaggugugug

SEQ ID NO: 2628 - RNA, 10 nt, Unknown
  source: /note="Description of Unknown: Exemplary gene or splice site sequence"
uagguguugg

SEQ ID NO: 2629 - RNA, 10 nt, Unknown
  source: /note="Description of Unknown: Exemplary gene or splice site sequence"
uagguuaagc

SEQ ID NO: 2630 - RNA, 10 nt, Unknown
  source: /note="Description of Unknown: Exemplary gene or splice site sequence"
uagguuagac

SEQ ID NO: 2631 - RNA, 10 nt, Unknown
  source: /note="Description of Unknown: Exemplary gene or splice site sequence"
uagguuagcc

SEQ ID NO: 2632 - RNA, 10 nt, Unknown
  source: /note="Description of Unknown: Exemplary gene or splice site sequence"
uagguuaggc

SEQ ID NO: 2633 - RNA, 10 nt, Unknown
  source: /note="Description of Unknown: Exemplary gene or splice site sequence"
uagguuagua

SEQ ID NO: 2634 - RNA, 10 nt, Unknown
  source: /note="Description of Unknown: Exemplary gene or splice site sequence"
uagguuaguc

SEQ ID NO: 2635 - RNA, 10 nt, Unknown
  source: /note="Description of Unknown: Exemplary gene or splice site sequence"
uagguuagug

SEQ ID NO: 2636 - RNA, 10 nt, Unknown
  source: /note="Description of Unknown: Exemplary gene or splice site sequence"
uagguucccc

SEQ ID NO: 2637 - RNA, 10 nt, Unknown
  source: /note="Description of Unknown: Exemplary gene or splice site sequence"
uagguucuac

SEQ ID NO: 2638 - RNA, 10 nt, Unknown
  source: /note="Description of Unknown: Exemplary gene or splice site sequence"
uagguuggua

SEQ ID NO: 2639 - RNA, 10 nt, Unknown
  source: /note="Description of Unknown: Exemplary gene or splice site sequence"
uagguugguu

SEQ ID NO: 2640 - RNA, 10 nt, Unknown
  source: /note="Description of Unknown: Exemplary gene or splice site sequence"
uagguugucc

SEQ ID NO: 2641 - RNA, 10 nt, Unknown
  source: /note="Description of Unknown: Exemplary gene or splice site sequence"
uagguuuauu

SEQ ID NO: 2642 - RNA, 10 nt, Unknown
  source: /note="Description of Unknown: Exemplary gene or splice site sequence"
uagguuugcc

SEQ ID NO: 2643 - RNA, 10 nt, Unknown
  source: /note="Description of Unknown: Exemplary gene or splice site sequence"
uagguuugua

SEQ ID NO: 2644 - RNA, 10 nt, Unknown
  source: /note="Description of Unknown: Exemplary gene or splice site sequence"
uagguuuguc

SEQ ID NO: 2645 - RNA, 10 nt, Unknown
  source: /note="Description of Unknown: Exemplary gene or splice site sequence"
uagguuugug

SEQ ID NO: 2646 - RNA, 10 nt, Unknown
  source: /note="Description of Unknown: Exemplary gene or splice site sequence"
uagguuuguu

SEQ ID NO: 2647 - RNA, 10 nt, Unknown
  source: /note="Description of Unknown: Exemplary gene or splice site sequence"
uagguuuuuc

SEQ ID NO: 2648 - RNA, 10 nt, Unknown
  source: /note="Description of Unknown: Exemplary gene or splice site sequence"
uagguuuuug

SEQ ID NO: 2649 - RNA, 10 nt, Unknown
  source: /note="Description of Unknown: Exemplary gene or splice site sequence"
uauguaagaa

SEQ ID NO: 2650 - RNA, 10 nt, Unknown
  source: /note="Description of Unknown: Exemplary gene or splice site sequence"
uauguaagau

SEQ ID NO: 2651 - RNA, 10 nt, Unknown
  source: /note="Description of Unknown: Exemplary gene or splice site sequence"
uauguaagca

SEQ ID NO: 2652 - RNA, 10 nt, Unknown
  source: /note="Description of Unknown: Exemplary gene or splice site sequence"
uauguaagcc

SEQ ID NO: 2653 - RNA, 10 nt, Unknown
  source: /note="Description of Unknown: Exemplary gene or splice site sequence"
uauguaagua

SEQ ID NO: 2654 - RNA, 10 nt, Unknown
  source: /note="Description of Unknown: Exemplary gene or splice site sequence"
uauguaaguc

SEQ ID NO: 2655 - RNA, 10 nt, Unknown
  source: /note="Description of Unknown: Exemplary gene or splice site sequence"
uauguaagug

SEQ ID NO: 2656 - RNA, 10 nt, Unknown
  source: /note="Description of Unknown: Exemplary gene or splice site sequence"
uauguaaguu

SEQ ID NO: 2657 - RNA, 10 nt, Unknown
  source: /note="Description of Unknown: Exemplary gene or splice site sequence"
uauguacgug

SEQ ID NO: 2658 - RNA, 10 nt, Unknown
  source: /note="Description of Unknown: Exemplary gene or splice site sequence"
uauguacguu

SEQ ID NO: 2659 - RNA, 10 nt, Unknown
  source: /note="Description of Unknown: Exemplary gene or splice site sequence"
uauguagguc

SEQ ID NO: 2660 - RNA, 10 nt, Unknown
  source: /note="Description of Unknown: Exemplary gene or splice site sequence"
uauguagguu

SEQ ID NO: 2661 - RNA, 10 nt, Unknown
  source: /note="Description of Unknown: Exemplary gene or splice site sequence"
uauguauccu

SEQ ID NO: 2662 - RNA, 10 nt, Unknown
  source: /note="Description of Unknown: Exemplary gene or splice site sequence"
uauguaucuc

SEQ ID NO: 2663 - RNA, 10 nt, Unknown
  source: /note="Description of Unknown: Exemplary gene or splice site sequence"
uauguaugua

SEQ ID NO: 2664 - RNA, 10 nt, Unknown
  source: /note="Description of Unknown: Exemplary gene or splice site sequence"
uauguauguc

SEQ ID NO: 2665 - RNA, 10 nt, Unknown
  source: /note="Description of Unknown: Exemplary gene or splice site sequence"
uauguaugug

SEQ ID NO: 2666 - RNA, 10 nt, Unknown
  source: /note="Description of Unknown: Exemplary gene or splice site sequence"
uauguauuau

SEQ ID NO: 2667 - RNA, 10 nt, Unknown
  source: /note="Description of Unknown: Exemplary gene or splice site sequence"
uaugucagaa

SEQ ID NO: 2668 - RNA, 10 nt, Unknown
  source: /note="Description of Unknown: Exemplary gene or splice site sequence"
uaugucugua

SEQ ID NO: 2669 - RNA, 10 nt, Unknown
  source: /note="Description of Unknown: Exemplary gene or splice site sequence"
uaugugaaua

SEQ ID NO: 2670 - RNA, 10 nt, Unknown
  source: /note="Description of Unknown: Exemplary gene or splice site sequence"
uaugugacag

SEQ ID NO: 2671 - RNA, 10 nt, Unknown
  source: /note="Description of Unknown: Exemplary gene or splice site sequence"
uaugugagua

SEQ ID NO: 2672 - RNA, 10 nt, Unknown
  source: /note="Description of Unknown: Exemplary gene or splice site sequence"
uaugugagug

SEQ ID NO: 2673 - RNA, 10 nt, Unknown
  source: /note="Description of Unknown: Exemplary gene or splice site sequence"
uaugugaguu

SEQ ID NO: 2674 - RNA, 10 nt, Unknown
  source: /note="Description of Unknown: Exemplary gene or splice site sequence"
uaugugggca

SEQ ID NO: 2675 - RNA, 10 nt, Unknown
  source: /note="Description of Unknown: Exemplary gene or splice site sequence"
uaugugugua

SEQ ID NO: 2676 - RNA, 10 nt, Unknown
  source: /note="Description of Unknown: Exemplary gene or splice site sequence"
uauguguuua

SEQ ID NO: 2677 - RNA, 10 nt, Unknown
  source: /note="Description of Unknown: Exemplary gene or splice site sequence"
uauguuuugu

SEQ ID NO: 2678 - RNA, 10 nt, Unknown
  source: /note="Description of Unknown: Exemplary gene or splice site sequence"
ucagcgacau

SEQ ID NO: 2679 - RNA, 10 nt, Unknown
  source: /note="Description of Unknown: Exemplary gene or splice site sequence"
ucaguaaaau

SEQ ID NO: 2680 - RNA, 10 nt, Unknown
  source: /note="Description of Unknown: Exemplary gene or splice site sequence"
ucaguaaaua

SEQ ID NO: 2681 - RNA, 10 nt, Unknown
  source: /note="Description of Unknown: Exemplary gene or splice site sequence"
ucaguaacug

SEQ ID NO: 2682 - RNA, 10 nt, Unknown
  source: /note="Description of Unknown: Exemplary gene or splice site sequence"
ucaguaagaa

SEQ ID NO: 2683 - RNA, 10 nt, Unknown
  source: /note="Description of Unknown: Exemplary gene or splice site sequence"
ucaguaagag

SEQ ID NO: 2684 - RNA, 10 nt, Unknown
  source: /note="Description of Unknown: Exemplary gene or splice site sequence"
ucaguaagau

SEQ ID NO: 2685 - RNA, 10 nt, Unknown
  source: /note="Description of Unknown: Exemplary gene or splice site sequence"
ucaguaagca

SEQ ID NO: 2686 - RNA, 10 nt, Unknown
  source: /note="Description of Unknown: Exemplary gene or splice site sequence"
ucaguaagcc

SEQ ID NO: 2687 - RNA, 10 nt, Unknown
  source: /note="Description of Unknown: Exemplary gene or splice site sequence"
ucaguaagcu

SEQ ID NO: 2688 - RNA, 10 nt, Unknown
  source: /note="Description of Unknown: Exemplary gene or splice site sequence"
ucaguaaggg

SEQ ID NO: 2689 - RNA, 10 nt, Unknown
  source: /note="Description of Unknown: Exemplary gene or splice site sequence"
ucaguaagua

SEQ ID NO: 2690 - RNA, 10 nt, Unknown
  source: /note="Description of Unknown: Exemplary gene or splice site sequence"
ucaguaaguc

SEQ ID NO: 2691 - RNA, 10 nt, Unknown
  source: /note="Description of Unknown: Exemplary gene or splice site sequence"
ucaguaagug

SEQ ID NO: 2692 - RNA, 10 nt, Unknown
  source: /note="Description of Unknown: Exemplary gene or splice site sequence"
ucaguaaguu

SEQ ID NO: 2693 - RNA, 10 nt, Unknown
  source: /note="Description of Unknown: Exemplary gene or splice site sequence"
ucaguaucuu

SEQ ID NO: 2694 - RNA, 10 nt, Unknown
  source: /note="Description of Unknown: Exemplary gene or splice site sequence"
ucaguaugga

SEQ ID NO: 2695 - RNA, 10 nt, Unknown
  source: /note="Description of Unknown: Exemplary gene or splice site sequence"
ucaguauggu

SEQ ID NO: 2696 - RNA, 10 nt, Unknown
  source: /note="Description of Unknown: Exemplary gene or splice site sequence"
ucagucccca

SEQ ID NO: 2697 - RNA, 10 nt, Unknown
  source: /note="Description of Unknown: Exemplary gene or splice site sequence"
ucagugagca

SEQ ID NO: 2698 - RNA, 10 nt, Unknown
  source: /note="Description of Unknown: Exemplary gene or splice site sequence"
ucagugagcu

SEQ ID NO: 2699 - RNA, 10 nt, Unknown
  source: /note="Description of Unknown: Exemplary gene or splice site sequence"
ucagugagua

SEQ ID NO: 2700 - RNA, 10 nt, Unknown
  source: /note="Description of Unknown: Exemplary gene or splice site sequence"
ucagugagug

SEQ ID NO: 2701 - RNA, 10 nt, Unknown
  source: /note="Description of Unknown: Exemplary gene or splice site sequence"
ucagugaguu

SEQ ID NO: 2702 - RNA, 10 nt, Unknown
  source: /note="Description of Unknown: Exemplary gene or splice site sequence"
ucagugauug

SEQ ID NO: 2703 - RNA, 10 nt, Unknown
  source: /note="Description of Unknown: Exemplary gene or splice site sequence"
ucagugggug

SEQ ID NO: 2704 - RNA, 10 nt, Unknown
  source: /note="Description of Unknown: Exemplary gene or splice site sequence"
ucaguugagc

SEQ ID NO: 2705 - RNA, 10 nt, Unknown
  source: /note="Description of Unknown: Exemplary gene or splice site sequence"
ucaguugauu

SEQ ID NO: 2706 - RNA, 10 nt, Unknown
  source: /note="Description of Unknown: Exemplary gene or splice site sequence"
ucaguuuagu

SEQ ID NO: 2707 - RNA, 10 nt, Unknown
  source: /note="Description of Unknown: Exemplary gene or splice site sequence"
uccguaagca

SEQ ID NO: 2708 - RNA, 10 nt, Unknown
  source: /note="Description of Unknown: Exemplary gene or splice site sequence"
uccguaagcu

SEQ ID NO: 2709 - RNA, 10 nt, Unknown
  source: /note="Description of Unknown: Exemplary gene or splice site sequence"
uccguaaguc

SEQ ID NO: 2710 - RNA, 10 nt, Unknown
  source: /note="Description of Unknown: Exemplary gene or splice site sequence"
uccguaagug

SEQ ID NO: 2711 - RNA, 10 nt, Unknown
  source: /note="Description of Unknown: Exemplary gene or splice site sequence"
uccguaauag

SEQ ID NO: 2712 - RNA, 10 nt, Unknown
  source: /note="Description of Unknown: Exemplary gene or splice site sequence"
uccguacuua

SEQ ID NO: 2713 - RNA, 10 nt, Unknown
  source: /note="Description of Unknown: Exemplary gene or splice site sequence"
uccguaugua

SEQ ID NO: 2714 - RNA, 10 nt, Unknown
  source: /note="Description of Unknown: Exemplary gene or splice site sequence"
uccguauguu

SEQ ID NO: 2715 - RNA, 10 nt, Unknown
  source: /note="Description of Unknown: Exemplary gene or splice site sequence"
uccgugagau

SEQ ID NO: 2716 - RNA, 10 nt, Unknown
  source: /note="Description of Unknown: Exemplary gene or splice site sequence"
uccgugaguc

SEQ ID NO: 2717 - RNA, 10 nt, Unknown
  source: /note="Description of Unknown: Exemplary gene or splice site sequence"
ucgguaaauu

SEQ ID NO: 2718 - RNA, 10 nt, Unknown
  source: /note="Description of Unknown: Exemplary gene or splice site sequence"
ucgguaagag

SEQ ID NO: 2719 - RNA, 10 nt, Unknown
  source: /note="Description of Unknown: Exemplary gene or splice site sequence"
ucgguaagcu

SEQ ID NO: 2720 - RNA, 10 nt, Unknown
  source: /note="Description of Unknown: Exemplary gene or splice site sequence"
ucgguacauc

SEQ ID NO: 2721 - RNA, 10 nt, Unknown
  source: /note="Description of Unknown: Exemplary gene or splice site sequence"
ucgguacucc

SEQ ID NO: 2722 - RNA, 10 nt, Unknown
  source: /note="Description of Unknown: Exemplary gene or splice site sequence"
ucgguagacc

SEQ ID NO: 2723 - RNA, 10 nt, Unknown
  source: /note="Description of Unknown: Exemplary gene or splice site sequence"
ucgguagguu

SEQ ID NO: 2724 - RNA, 10 nt, Unknown
  source: /note="Description of Unknown: Exemplary gene or splice site sequence"
ucgguaguaa

SEQ ID NO: 2725 - RNA, 10 nt, Unknown
  source: /note="Description of Unknown: Exemplary gene or splice site sequence"
ucgguaugug

SEQ ID NO: 2726 - RNA, 10 nt, Unknown
  source: /note="Description of Unknown: Exemplary gene or splice site sequence"
ucgguauguu

SEQ ID NO: 2727 - RNA, 10 nt, Unknown
  source: /note="Description of Unknown: Exemplary gene or splice site sequence"
ucgguauuga

SEQ ID NO: 2728 - RNA, 10 nt, Unknown
  source: /note="Description of Unknown: Exemplary gene or splice site sequence"
ucggucagua

SEQ ID NO: 2729 - RNA, 10 nt, Unknown
  source: /note="Description of Unknown: Exemplary gene or splice site sequence"
ucggucuuag

SEQ ID NO: 2730 - RNA, 10 nt, Unknown
  source: /note="Description of Unknown: Exemplary gene or splice site sequence"
ucggugaagu

SEQ ID NO: 2731 - RNA, 10 nt, Unknown
  source: /note="Description of Unknown: Exemplary gene or splice site sequence"
ucggugagaa

SEQ ID NO: 2732 - RNA, 10 nt, Unknown
  source: /note="Description of Unknown: Exemplary gene or splice site sequence"
ucggugagca

SEQ ID NO: 2733 - RNA, 10 nt, Unknown
  source: /note="Description of Unknown: Exemplary gene or splice site sequence"
ucggugaggc

SEQ ID NO: 2734 - RNA, 10 nt, Unknown
  source: /note="Description of Unknown: Exemplary gene or splice site sequence"
ucggugagua

SEQ ID NO: 2735 - RNA, 10 nt, Unknown
  source: /note="Description of Unknown: Exemplary gene or splice site sequence"
ucggugcgcu

SEQ ID NO: 2736 - RNA, 10 nt, Unknown
  source: /note="Description of Unknown: Exemplary gene or splice site sequence"
ucggugcuuu

SEQ ID NO: 2737 - RNA, 10 nt, Unknown
  source: /note="Description of Unknown: Exemplary gene or splice site sequence"
ucggugguuu

SEQ ID NO: 2738 - RNA, 10 nt, Unknown
  source: /note="Description of Unknown: Exemplary gene or splice site sequence"
ucgguuagcu

SEQ ID NO: 2739 - RNA, 10 nt, Unknown
  source: /note="Description of Unknown: Exemplary gene or splice site sequence"
ucuguaaaag

SEQ ID NO: 2740 - RNA, 10 nt, Unknown
  source: /note="Description of Unknown: Exemplary gene or splice site sequence"
ucuguaagaa

SEQ ID NO: 2741 - RNA, 10 nt, Unknown
  source: /note="Description of Unknown: Exemplary gene or splice site sequence"
ucuguaagau

SEQ ID NO: 2742 - RNA, 10 nt, Unknown
  source: /note="Description of Unknown: Exemplary gene or splice site sequence"
ucuguaagca

SEQ ID NO: 2743 - RNA, 10 nt, Unknown
  source: /note="Description of Unknown: Exemplary gene or splice site sequence"
ucuguaagcu

SEQ ID NO: 2744 - RNA, 10 nt, Unknown
  source: /note="Description of Unknown: Exemplary gene or splice site sequence"
ucuguaagua

SEQ ID NO: 2745 - RNA, 10 nt, Unknown
  source: /note="Description of Unknown: Exemplary gene or splice site sequence"
ucuguaaguc

SEQ ID NO: 2746 - RNA, 10 nt, Unknown
  source: /note="Description of Unknown: Exemplary gene or splice site sequence"
ucuguaagug

SEQ ID NO: 2747 - RNA, 10 nt, Unknown
  source: /note="Description of Unknown: Exemplary gene or splice site sequence"
ucuguaaguu

SEQ ID NO: 2748 - RNA, 10 nt, Unknown
  source: /note="Description of Unknown: Exemplary gene or splice site sequence"
ucuguaauaa

SEQ ID NO: 2749 - RNA, 10 nt, Unknown
  source: /note="Description of Unknown: Exemplary gene or splice site sequence"
ucuguaauga

SEQ ID NO: 2750 - RNA, 10 nt, Unknown
  source: /note="Description of Unknown: Exemplary gene or splice site sequence"
ucuguaaugu

SEQ ID NO: 2751 - RNA, 10 nt, Unknown
  source: /note="Description of Unknown: Exemplary gene or splice site sequence"
ucuguaggua

SEQ ID NO: 2752 - RNA, 10 nt, Unknown
  source: /note="Description of Unknown: Exemplary gene or splice site sequence"
ucuguagguu

SEQ ID NO: 2753 - RNA, 10 nt, Unknown
  source: /note="Description of Unknown: Exemplary gene or splice site sequence"
ucuguauaua

SEQ ID NO: 2754 - RNA, 10 nt, Unknown
  source: /note="Description of Unknown: Exemplary gene or splice site sequence"
ucuguaugac

SEQ ID NO: 2755 - RNA, 10 nt, Unknown
  source: /note="Description of Unknown: Exemplary gene or splice site sequence"
ucuguaugua

SEQ ID NO: 2756 - RNA, 10 nt, Unknown
  source: /note="Description of Unknown: Exemplary gene or splice site sequence"
ucuguccucg

SEQ ID NO: 2757 - RNA, 10 nt, Unknown
  source: /note="Description of Unknown: Exemplary gene or splice site sequence"
ucugugagag

SEQ ID NO: 2758 - RNA, 10 nt, Unknown
  source: /note="Description of Unknown: Exemplary gene or splice site sequence"
ucugugagcu

SEQ ID NO: 2759 - RNA, 10 nt, Unknown
  source: /note="Description of Unknown: Exemplary gene or splice site sequence"
ucugugagga

SEQ ID NO: 2760 - RNA, 10 nt, Unknown
  source: /note="Description of Unknown: Exemplary gene or splice site sequence"
ucugugagua

SEQ ID NO: 2761 - RNA, 10 nt, Unknown
  source: /note="Description of Unknown: Exemplary gene or splice site sequence"
ucugugaguc

SEQ ID NO: 2762 - RNA, 10 nt, Unknown
  source: /note="Description of Unknown: Exemplary gene or splice site sequence"
ucugugagug

SEQ ID NO: 2763 - RNA, 10 nt, Unknown
  source: /note="Description of Unknown: Exemplary gene or splice site sequence"
ucugugaguu

SEQ ID NO: 2764 - RNA, 10 nt, Unknown
  source: /note="Description of Unknown: Exemplary gene or splice site sequence"
ucugugcgua

SEQ ID NO: 2765 - RNA, 10 nt, Unknown
  source: /note="Description of Unknown: Exemplary gene or splice site sequence"
ucugugugag

SEQ ID NO: 2766 - RNA, 10 nt, Unknown
  source: /note="Description of Unknown: Exemplary gene or splice site sequence"
ugaguaacuu

SEQ ID NO: 2767 - RNA, 10 nt, Unknown
  source: /note="Description of Unknown: Exemplary gene or splice site sequence"
ugaguaagau

SEQ ID NO: 2768 - RNA, 10 nt, Unknown
  source: /note="Description of Unknown: Exemplary gene or splice site sequence"
ugaguaagca

SEQ ID NO: 2769 - RNA, 10 nt, Unknown
  source: /note="Description of Unknown: Exemplary gene or splice site sequence"
ugaguaagcu

SEQ ID NO: 2770 - RNA, 10 nt, Unknown
  source: /note="Description of Unknown: Exemplary gene or splice site sequence"
ugaguaaggc

SEQ ID NO: 2771 - RNA, 10 nt, Unknown
  source: /note="Description of Unknown: Exemplary gene or splice site sequence"
ugaguaaggu

SEQ ID NO: 2772 - RNA, 10 nt, Unknown
  source: /note="Description of Unknown: Exemplary gene or splice site sequence"
ugaguaagua

SEQ ID NO: 2773 - RNA, 10 nt, Unknown
  source: /note="Description of Unknown: Exemplary gene or splice site sequence"
ugaguaaguc

SEQ ID NO: 2774 - RNA, 10 nt, Unknown
  source: /note="Description of Unknown: Exemplary gene or splice site sequence"
ugaguaagug

SEQ ID NO: 2775 - RNA, 10 nt, Unknown
  source: /note="Description of Unknown: Exemplary gene or splice site sequence"
ugaguaaguu

SEQ ID NO: 2776 - RNA, 10 nt, Unknown
  source: /note="Description of Unknown: Exemplary gene or splice site sequence"
ugaguaaucc

SEQ ID NO: 2777 - RNA, 10 nt, Unknown
  source: /note="Description of Unknown: Exemplary gene or splice site sequence"
ugaguaauua

SEQ ID NO: 2778 - RNA, 10 nt, Unknown
  source: /note="Description of Unknown: Exemplary gene or splice site sequence"
ugaguacagu

SEQ ID NO: 2779 - RNA, 10 nt, Unknown
  source: /note="Description of Unknown: Exemplary gene or splice site sequence"
ugaguacgua

SEQ ID NO: 2780 - RNA, 10 nt, Unknown
  source: /note="Description of Unknown: Exemplary gene or splice site sequence"
ugaguacguu

SEQ ID NO: 2781 - RNA, 10 nt, Unknown
  source: /note="Description of Unknown: Exemplary gene or splice site sequence"
ugaguacugu

SEQ ID NO: 2782 - RNA, 10 nt, Unknown
  source: /note="Description of Unknown: Exemplary gene or splice site sequence"
ugaguagcug

SEQ ID NO: 2783 - RNA, 10 nt, Unknown
  source: /note="Description of Unknown: Exemplary gene or splice site sequence"
ugaguaggua

SEQ ID NO: 2784 - RNA, 10 nt, Unknown
  source: /note="Description of Unknown: Exemplary gene or splice site sequence"
ugaguauaaa

SEQ ID NO: 2785 - RNA, 10 nt, Unknown
  source: /note="Description of Unknown: Exemplary gene or splice site sequence"
ugaguaugcu

SEQ ID NO: 2786 - RNA, 10 nt, Unknown
  source: /note="Description of Unknown: Exemplary gene or splice site sequence"
ugaguaugga

SEQ ID NO: 2787 - RNA, 10 nt, Unknown
  source: /note="Description of Unknown: Exemplary gene or splice site sequence"
ugaguaugua

SEQ ID NO: 2788 - RNA, 10 nt, Unknown
  source: /note="Description of Unknown: Exemplary gene or splice site sequence"
ugaguauguc

SEQ ID NO: 2789 - RNA, 10 nt, Unknown
  source: /note="Description of Unknown: Exemplary gene or splice site sequence"
ugaguauguu

SEQ ID NO: 2790 - RNA, 10 nt, Unknown
  source: /note="Description of Unknown: Exemplary gene or splice site sequence"
ugagucagag

SEQ ID NO: 2791 - RNA, 10 nt, Unknown
  source: /note="Description of Unknown: Exemplary gene or splice site sequence"
ugagucuacg

SEQ ID NO: 2792 - RNA, 10 nt, Unknown
  source: /note="Description of Unknown: Exemplary gene or splice site sequence"
ugagugaaua

SEQ ID NO: 2793 - RNA, 10 nt, Unknown
  source: /note="Description of Unknown: Exemplary gene or splice site sequence"
ugagugaauu

SEQ ID NO: 2794 - RNA, 10 nt, Unknown
  source: /note="Description of Unknown: Exemplary gene or splice site sequence"
ugagugagaa

SEQ ID NO: 2795 - RNA, 10 nt, Unknown
  source: /note="Description of Unknown: Exemplary gene or splice site sequence"
ugagugagau

SEQ ID NO: 2796 - RNA, 10 nt, Unknown
  source: /note="Description of Unknown: Exemplary gene or splice site sequence"
ugagugagca

SEQ ID NO: 2797 - RNA, 10 nt, Unknown
  source: /note="Description of Unknown: Exemplary gene or splice site sequence"
ugagugagcc

SEQ ID NO: 2798 - RNA, 10 nt, Unknown
  source: /note="Description of Unknown: Exemplary gene or splice site sequence"
ugagugagga

SEQ ID NO: 2799 - RNA, 10 nt, Unknown
  source: /note="Description of Unknown: Exemplary gene or splice site sequence"
ugagugagua

SEQ ID NO: 2800 - RNA, 10 nt, Unknown
  source: /note="Description of Unknown: Exemplary gene or splice site sequence"
ugagugagug

SEQ ID NO: 2801 - RNA, 10 nt, Unknown
  source: /note="Description of Unknown: Exemplary gene or splice site sequence"
ugagugaguu

SEQ ID NO: 2802 - RNA, 10 nt, Unknown
  source: /note="Description of Unknown: Exemplary gene or splice site sequence"
ugagugggaa

SEQ ID NO: 2803 - RNA, 10 nt, Unknown
  source: /note="Description of Unknown: Exemplary gene or splice site sequence"
ugaguuaaga

SEQ ID NO: 2804 - RNA, 10 nt, Unknown
  source: /note="Description of Unknown: Exemplary gene or splice site sequence"
ugaguuaaug

SEQ ID NO: 2805 - RNA, 10 nt, Unknown
  source: /note="Description of Unknown: Exemplary gene or splice site sequence"
ugaguuacgg

SEQ ID NO: 2806 - RNA, 10 nt, Unknown
  source: /note="Description of Unknown: Exemplary gene or splice site sequence"
ugaguuaggu

SEQ ID NO: 2807 - RNA, 10 nt, Unknown
  source: /note="Description of Unknown: Exemplary gene or splice site sequence"
ugaguucuau

SEQ ID NO: 2808 - RNA, 10 nt, Unknown
  source: /note="Description of Unknown: Exemplary gene or splice site sequence"
ugaguugguu

SEQ ID NO: 2809 - RNA, 10 nt, Unknown
  source: /note="Description of Unknown: Exemplary gene or splice site sequence"
ugaguuguag

SEQ ID NO: 2810 - RNA, 10 nt, Unknown
  source: /note="Description of Unknown: Exemplary gene or splice site sequence"
ugaguuuauc

SEQ ID NO: 2811 - RNA, 10 nt, Unknown
  source: /note="Description of Unknown: Exemplary gene or splice site sequence"
ugcguaaguc

SEQ ID NO: 2812 - RNA, 10 nt, Unknown
  source: /note="Description of Unknown: Exemplary gene or splice site sequence"
ugcguaagug

SEQ ID NO: 2813 - RNA, 10 nt, Unknown
  source: /note="Description of Unknown: Exemplary gene or splice site sequence"
ugcguacggc

SEQ ID NO: 2814 - RNA, 10 nt, Unknown
  source: /note="Description of Unknown: Exemplary gene or splice site sequence"
ugcguacggg

SEQ ID NO: 2815 - RNA, 10 nt, Unknown
  source: /note="Description of Unknown: Exemplary gene or splice site sequence"
ugcguaugua

SEQ ID NO: 2816 - RNA, 10 nt, Unknown
  source: /note="Description of Unknown: Exemplary gene or splice site sequence"
ugggcaaguc

SEQ ID NO: 2817 - RNA, 10 nt, Unknown
  source: /note="Description of Unknown: Exemplary gene or splice site sequence"
ugggcaagug

SEQ ID NO: 2818 - RNA, 10 nt, Unknown
  source: /note="Description of Unknown: Exemplary gene or splice site sequence"
ugggcacauc

SEQ ID NO: 2819 - RNA, 10 nt, Unknown
  source: /note="Description of Unknown: Exemplary gene or splice site sequence"
ugggccacgu

SEQ ID NO: 2820 - RNA, 10 nt, Unknown
  source: /note="Description of Unknown: Exemplary gene or splice site sequence"
ugggccccgg

SEQ ID NO: 2821 - RNA, 10 nt, Unknown
  source: /note="Description of Unknown: Exemplary gene or splice site sequence"
uggguaaaau

SEQ ID NO: 2822 - RNA, 10 nt, Unknown
  source: /note="Description of Unknown: Exemplary gene or splice site sequence"
uggguaaagc

SEQ ID NO: 2823 - RNA, 10 nt, Unknown
  source: /note="Description of Unknown: Exemplary gene or splice site sequence"
uggguaaagg

SEQ ID NO: 2824 - RNA, 10 nt, Unknown
  source: /note="Description of Unknown: Exemplary gene or splice site sequence"
uggguaaagu

SEQ ID NO: 2825 - RNA, 10 nt, Unknown
  source: /note="Description of Unknown: Exemplary gene or splice site sequence"
uggguaaaua

SEQ ID NO: 2826 - RNA, 10 nt, Unknown
  source: /note="Description of Unknown: Exemplary gene or splice site sequence"
uggguaaaug

SEQ ID NO: 2827 - RNA, 10 nt, Unknown
  source: /note="Description of Unknown: Exemplary gene or splice site sequence"
uggguaaauu

SEQ ID NO: 2828 - RNA, 10 nt, Unknown
  source: /note="Description of Unknown: Exemplary gene or splice site sequence"
uggguaacag

SEQ ID NO: 2829 - RNA, 10 nt, Unknown
  source: /note="Description of Unknown: Exemplary gene or splice site sequence"
uggguaacau

SEQ ID NO: 2830 - RNA, 10 nt, Unknown
  source: /note="Description of Unknown: Exemplary gene or splice site sequence"
uggguaacua

SEQ ID NO: 2831 - RNA, 10 nt, Unknown
  source: /note="Description of Unknown: Exemplary gene or splice site sequence"
uggguaacuu

SEQ ID NO: 2832 - RNA, 10 nt, Unknown
  source: /note="Description of Unknown: Exemplary gene or splice site sequence"
uggguaagaa

SEQ ID NO: 2833 - RNA, 10 nt, Unknown
  source: /note="Description of Unknown: Exemplary gene or splice site sequence"
uggguaagac

SEQ ID NO: 2834 - RNA, 10 nt, Unknown
  source: /note="Description of Unknown: Exemplary gene or splice site sequence"
uggguaagag

SEQ ID NO: 2835 - RNA, 10 nt, Unknown
  source: /note="Description of Unknown: Exemplary gene or splice site sequence"
uggguaagau

SEQ ID NO: 2836 - RNA, 10 nt, Unknown
  source: /note="Description of Unknown: Exemplary gene or splice site sequence"
uggguaagca

SEQ ID NO: 2837 - RNA, 10 nt, Unknown
  source: /note="Description of Unknown: Exemplary gene or splice site sequence"
uggguaagcc

SEQ ID NO: 2838 - RNA, 10 nt, Unknown
  source: /note="Description of Unknown: Exemplary gene or splice site sequence"
uggguaagcu

SEQ ID NO: 2839 - RNA, 10 nt, Unknown
  source: /note="Description of Unknown: Exemplary gene or splice site sequence"
uggguaaggg

SEQ ID NO: 2840 - RNA, 10 nt, Unknown
  source: /note="Description of Unknown: Exemplary gene or splice site sequence"
uggguaaggu

SEQ ID NO: 2841 - RNA, 10 nt, Unknown
  source: /note="Description of Unknown: Exemplary gene or splice site sequence"
uggguaagua

SEQ ID NO: 2842 - RNA, 10 nt, Unknown
  source: /note="Description of Unknown: Exemplary gene or splice site sequence"
uggguaaguc

SEQ ID NO: 2843 - RNA, 10 nt, Unknown
  source: /note="Description of Unknown: Exemplary gene or splice site sequence"
uggguaagug

SEQ ID NO: 2844 - RNA, 10 nt, Unknown
  source: /note="Description of Unknown: Exemplary gene or splice site sequence"
uggguaaguu

SEQ ID NO: 2845 - RNA, 10 nt, Unknown
  source: /note="Description of Unknown: Exemplary gene or splice site sequence"
uggguaaugu

SEQ ID NO: 2846 - RNA, 10 nt, Unknown
  source: /note="Description of Unknown: Exemplary gene or splice site sequence"
uggguaauua

SEQ ID NO: 2847 - RNA, 10 nt, Unknown
  source: /note="Description of Unknown: Exemplary gene or splice site sequence"
uggguaauuu

SEQ ID NO: 2848 - RNA, 10 nt, Unknown
  source: /note="Description of Unknown: Exemplary gene or splice site sequence"
uggguacaaa

SEQ ID NO: 2849 - RNA, 10 nt, Unknown
  source: /note="Description of Unknown: Exemplary gene or splice site sequence"
uggguacagu

SEQ ID NO: 2850 - RNA, 10 nt, Unknown
  source: /note="Description of Unknown: Exemplary gene or splice site sequence"
uggguacuac

SEQ ID NO: 2851 - RNA, 10 nt, Unknown
  source: /note="Description of Unknown: Exemplary gene or splice site sequence"
uggguaggga

SEQ ID NO: 2852 - RNA, 10 nt, Unknown
  source: /note="Description of Unknown: Exemplary gene or splice site sequence"
uggguagguc

SEQ ID NO: 2853 - RNA, 10 nt, Unknown
  source: /note="Description of Unknown: Exemplary gene or splice site sequence"
uggguaggug

SEQ ID NO: 2854 - RNA, 10 nt, Unknown
  source: /note="Description of Unknown: Exemplary gene or splice site sequence"
uggguagguu

SEQ ID NO: 2855 - RNA, 10 nt, Unknown
  source: /note="Description of Unknown: Exemplary gene or splice site sequence"
uggguaguua

SEQ ID NO: 2856 - RNA, 10 nt, Unknown
  source: /note="Description of Unknown: Exemplary gene or splice site sequence"
uggguauagu

SEQ ID NO: 2857 - RNA, 10 nt, Unknown
  source: /note="Description of Unknown: Exemplary gene or splice site sequence"
uggguaugaa

SEQ ID NO: 2858 - RNA, 10 nt, Unknown
  source: /note="Description of Unknown: Exemplary gene or splice site sequence"
uggguaugac

SEQ ID NO: 2859 - RNA, 10 nt, Unknown
  source: /note="Description of Unknown: Exemplary gene or splice site sequence"
uggguaugag

SEQ ID NO: 2860 - RNA, 10 nt, Unknown
  source: /note="Description of Unknown: Exemplary gene or splice site sequence"
uggguaugua

SEQ ID NO: 2861 - RNA, 10 nt, Unknown
  source: /note="Description of Unknown: Exemplary gene or splice site sequence"
uggguauguc

SEQ ID NO: 2862 - RNA, 10 nt, Unknown
  source: /note="Description of Unknown: Exemplary gene or splice site sequence"
uggguaugug

SEQ ID NO: 2863 - RNA, 10 nt, Unknown
  source: /note="Description of Unknown: Exemplary gene or splice site sequence"
uggguauguu

SEQ ID NO: 2864 - RNA, 10 nt, Unknown
  source: /note="Description of Unknown: Exemplary gene or splice site sequence"
uggguauuug

SEQ ID NO: 2865 - RNA, 10 nt, Unknown
  source: /note="Description of Unknown: Exemplary gene or splice site sequence"
ugggucuuug

SEQ ID NO: 2866 - RNA, 10 nt, Unknown
  source: /note="Description of Unknown: Exemplary gene or splice site sequence"
ugggugaccu

SEQ ID NO: 2867 - RNA, 10 nt, Unknown
  source: /note="Description of Unknown: Exemplary gene or splice site sequence"
ugggugacua

SEQ ID NO: 2868 - RNA, 10 nt, Unknown
  source: /note="Description of Unknown: Exemplary gene or splice site sequence"
ugggugagac

SEQ ID NO: 2869 - RNA, 10 nt, Unknown
  source: /note="Description of Unknown: Exemplary gene or splice site sequence"
ugggugagag

SEQ ID NO: 2870 - RNA, 10 nt, Unknown
  source: /note="Description of Unknown: Exemplary gene or splice site sequence"
ugggugagca

SEQ ID NO: 2871 - RNA, 10 nt, Unknown
  source: /note="Description of Unknown: Exemplary gene or splice site sequence"
ugggugagcc

SEQ ID NO: 2872 - RNA, 10 nt, Unknown
  source: /note="Description of Unknown: Exemplary gene or splice site sequence"
ugggugagga

SEQ ID NO: 2873 - RNA, 10 nt, Unknown
  source: /note="Description of Unknown: Exemplary gene or splice site sequence"
ugggugaggc

SEQ ID NO: 2874 - RNA, 10 nt, Unknown
  source: /note="Description of Unknown: Exemplary gene or splice site sequence"
ugggugaggg

SEQ ID NO: 2875 - RNA, 10 nt, Unknown
  source: /note="Description of Unknown: Exemplary gene or splice site sequence"
ugggugagua

SEQ ID NO: 2876 - RNA, 10 nt, Unknown
  source: /note="Description of Unknown: Exemplary gene or splice site sequence"
ugggugaguc

SEQ ID NO: 2877 - RNA, 10 nt, Unknown
  source: /note="Description of Unknown: Exemplary gene or splice site sequence"
ugggugagug

SEQ ID NO: 2878 - RNA, 10 nt, Unknown
  source: /note="Description of Unknown: Exemplary gene or splice site sequence"
ugggugaguu

SEQ ID NO: 2879 - RNA, 10 nt, Unknown
  source: /note="Description of Unknown: Exemplary gene or splice site sequence"
ugggugcgug

SEQ ID NO: 2880 - RNA, 10 nt, Unknown
  source: /note="Description of Unknown: Exemplary gene or splice site sequence"
uggguggagg

SEQ ID NO: 2881 - RNA, 10 nt, Unknown
  source: /note="Description of Unknown: Exemplary gene or splice site sequence"
uggguggcuu

SEQ ID NO: 2882 - RNA, 10 nt, Unknown
  source: /note="Description of Unknown: Exemplary gene or splice site sequence"
uggguggggg

SEQ ID NO: 2883 - RNA, 10 nt, Unknown
  source: /note="Description of Unknown: Exemplary gene or splice site sequence"
ugggugggua

SEQ ID NO: 2884 - RNA, 10 nt, Unknown
  source: /note="Description of Unknown: Exemplary gene or splice site sequence"
uggguggguc

SEQ ID NO: 2885 - RNA, 10 nt, Unknown
  source: /note="Description of Unknown: Exemplary gene or splice site sequence"
ugggugggug

SEQ ID NO: 2886 - RNA, 10 nt, Unknown
  source: /note="Description of Unknown: Exemplary gene or splice site sequence"
uggguggguu

SEQ ID NO: 2887 - RNA, 10 nt, Unknown
  source: /note="Description of Unknown: Exemplary gene or splice site sequence"
ugggugugga

SEQ ID NO: 2888 - RNA, 10 nt, Unknown
  source: /note="Description of Unknown: Exemplary gene or splice site sequence"
uggguguguc

SEQ ID NO: 2889 - RNA, 10 nt, Unknown
  source: /note="Description of Unknown: Exemplary gene or splice site sequence"
ugggugugug

SEQ ID NO: 2890 - RNA, 10 nt, Unknown
  source: /note="Description of Unknown: Exemplary gene or splice site sequence"
uggguguguu

SEQ ID NO: 2891 - RNA, 10 nt, Unknown
  source: /note="Description of Unknown: Exemplary gene or splice site sequence"
uggguguuua

SEQ ID NO: 2892 - RNA, 10 nt, Unknown
  source: /note="Description of Unknown: Exemplary gene or splice site sequence"
uggguuaaug

SEQ ID NO: 2893 - RNA, 10 nt, Unknown
  source: /note="Description of Unknown: Exemplary gene or splice site sequence"
uggguuaguc

SEQ ID NO: 2894 - RNA, 10 nt, Unknown
  source: /note="Description of Unknown: Exemplary gene or splice site sequence"
uggguuagug

SEQ ID NO: 2895 - RNA, 10 nt, Unknown
  source: /note="Description of Unknown: Exemplary gene or splice site sequence"
uggguuaguu

SEQ ID NO: 2896 - RNA, 10 nt, Unknown
  source: /note="Description of Unknown: Exemplary gene or splice site sequence"
uggguucaag

SEQ ID NO: 2897 - RNA, 10 nt, Unknown
  source: /note="Description of Unknown: Exemplary gene or splice site sequence"
uggguucgua

SEQ ID NO: 2898 - RNA, 10 nt, Unknown
  source: /note="Description of Unknown: Exemplary gene or splice site sequence"
uggguuggug

SEQ ID NO: 2899 - RNA, 10 nt, Unknown
  source: /note="Description of Unknown: Exemplary gene or splice site sequence"
uggguuuaag

SEQ ID NO: 2900 - RNA, 10 nt, Unknown
  source: /note="Description of Unknown: Exemplary gene or splice site sequence"
uggguuugua

SEQ ID NO: 2901 - RNA, 10 nt, Unknown
  source: /note="Description of Unknown: Exemplary gene or splice site sequence"
ugugcaagua

SEQ ID NO: 2902 - RNA, 10 nt, Unknown
  source: /note="Description of Unknown: Exemplary gene or splice site sequence"
uguguaaaua

SEQ ID NO: 2903 - RNA, 10 nt, Unknown
  source: /note="Description of Unknown: Exemplary gene or splice site sequence"
uguguaagaa

SEQ ID NO: 2904 - RNA, 10 nt, Unknown
  source: /note="Description of Unknown: Exemplary gene or splice site sequence"
uguguaagac

SEQ ID NO: 2905 - RNA, 10 nt, Unknown
  source: /note="Description of Unknown: Exemplary gene or splice site sequence"
uguguaagag

SEQ ID NO: 2906 - RNA, 10 nt, Unknown
  source: /note="Description of Unknown: Exemplary gene or splice site sequence"
uguguaaggu

SEQ ID NO: 2907 - RNA, 10 nt, Unknown
  source: /note="Description of Unknown: Exemplary gene or splice site sequence"
uguguaagua

SEQ ID NO: 2908 - RNA, 10 nt, Unknown
  source: /note="Description of Unknown: Exemplary gene or splice site sequence"
uguguaaguc

SEQ ID NO: 2909 - RNA, 10 nt, Unknown
  source: /note="Description of Unknown: Exemplary gene or splice site sequence"
uguguaaguu

SEQ ID NO: 2910 - RNA, 10 nt, Unknown
  source: /note="Description of Unknown: Exemplary gene or splice site sequence"
uguguacuuc

SEQ ID NO: 2911 - RNA, 10 nt, Unknown
  source: /note="Description of Unknown: Exemplary gene or splice site sequence"
uguguaggcg

SEQ ID NO: 2912 - RNA, 10 nt, Unknown
  source: /note="Description of Unknown: Exemplary gene or splice site sequence"
uguguaggua

SEQ ID NO: 2913 - RNA, 10 nt, Unknown
  source: /note="Description of Unknown: Exemplary gene or splice site sequence"
uguguaguua

SEQ ID NO: 2914 - RNA, 10 nt, Unknown
  source: /note="Description of Unknown: Exemplary gene or splice site sequence"
uguguaugug

SEQ ID NO: 2915 - RNA, 10 nt, Unknown
  source: /note="Description of Unknown: Exemplary gene or splice site sequence"
ugugucagua

SEQ ID NO: 2916 - RNA, 10 nt, Unknown
  source: /note="Description of Unknown: Exemplary gene or splice site sequence"
ugugucugua

SEQ ID NO: 2917 - RNA, 10 nt, Unknown
  source: /note="Description of Unknown: Exemplary gene or splice site sequence"
ugugucuguc

SEQ ID NO: 2918 - RNA, 10 nt, Unknown
  source: /note="Description of Unknown: Exemplary gene or splice site sequence"
ugugugaccc

SEQ ID NO: 2919 - RNA, 10 nt, Unknown
  source: /note="Description of Unknown: Exemplary gene or splice site sequence"
ugugugagau

SEQ ID NO: 2920 - RNA, 10 nt, Unknown
  source: /note="Description of Unknown: Exemplary gene or splice site sequence"
ugugugagca

SEQ ID NO: 2921 - RNA, 10 nt, Unknown
  source: /note="Description of Unknown: Exemplary gene or splice site sequence"
ugugugagcc

SEQ ID NO: 2922 - RNA, 10 nt, Unknown
  source: /note="Description of Unknown: Exemplary gene or splice site sequence"
ugugugagua

SEQ ID NO: 2923 - RNA, 10 nt, Unknown
  source: /note="Description of Unknown: Exemplary gene or splice site sequence"
ugugugaguc

SEQ ID NO: 2924 - RNA, 10 nt, Unknown
  source: /note="Description of Unknown: Exemplary gene or splice site sequence"
ugugugagug

SEQ ID NO: 2925 - RNA, 10 nt, Unknown
  source: /note="Description of Unknown: Exemplary gene or splice site sequence"
ugugugcgug

SEQ ID NO: 2926 - RNA, 10 nt, Unknown
  source: /note="Description of Unknown: Exemplary gene or splice site sequence"
ugugugggug

SEQ ID NO: 2927 - RNA, 10 nt, Unknown
  source: /note="Description of Unknown: Exemplary gene or splice site sequence"
uguguggguu

SEQ ID NO: 2928 - RNA, 10 nt, Unknown
  source: /note="Description of Unknown: Exemplary gene or splice site sequence"
ugugugugag

SEQ ID NO: 2929 - RNA, 10 nt, Unknown
  source: /note="Description of Unknown: Exemplary gene or splice site sequence"
uguguguucu

SEQ ID NO: 2930 - RNA, 10 nt, Unknown
  source: /note="Description of Unknown: Exemplary gene or splice site sequence"
uguguuuaga

SEQ ID NO: 2931 - RNA, 10 nt, Unknown
  source: /note="Description of Unknown: Exemplary gene or splice site sequence"
uuaguaaaua

SEQ ID NO: 2932 - RNA, 10 nt, Unknown
  source: /note="Description of Unknown: Exemplary gene or splice site sequence"
uuaguaagaa

SEQ ID NO: 2933 - RNA, 10 nt, Unknown
  source: /note="Description of Unknown: Exemplary gene or splice site sequence"
uuaguaagua

SEQ ID NO: 2934 - RNA, 10 nt, Unknown
  source: /note="Description of Unknown: Exemplary gene or splice site sequence"
uuaguaagug

SEQ ID NO: 2935 - RNA, 10 nt, Unknown
  source: /note="Description of Unknown: Exemplary gene or splice site sequence"
uuaguaaguu

SEQ ID NO: 2936 - RNA, 10 nt, Unknown
  source: /note="Description of Unknown: Exemplary gene or splice site sequence"
uuaguaggug

SEQ ID NO: 2937 - RNA, 10 nt, Unknown
  source: /note="Description of Unknown: Exemplary gene or splice site sequence"
uuagugagca

SEQ ID NO: 2938 - RNA, 10 nt, Unknown
  source: /note="Description of Unknown: Exemplary gene or splice site sequence"
uuagugaguu

SEQ ID NO: 2939 - RNA, 10 nt, Unknown
  source: /note="Description of Unknown: Exemplary gene or splice site sequence"
uuaguuaagu

SEQ ID NO: 2940 - RNA, 10 nt, Unknown
  source: /note="Description of Unknown: Exemplary gene or splice site sequence"
uucguaaguc

SEQ ID NO: 2941 - RNA, 10 nt, Unknown
  source: /note="Description of Unknown: Exemplary gene or splice site sequence"
uucguaaguu

SEQ ID NO: 2942 - RNA, 10 nt, Unknown
  source: /note="Description of Unknown: Exemplary gene or splice site sequence"
uucguaauua

SEQ ID NO: 2943 - RNA, 10 nt, Unknown
  source: /note="Description of Unknown: Exemplary gene or splice site sequence"
uucgugagua

SEQ ID NO: 2944 - RNA, 10 nt, Unknown
  source: /note="Description of Unknown: Exemplary gene or splice site sequence"
uucgugaguu

SEQ ID NO: 2945 - RNA, 10 nt, Unknown
  source: /note="Description of Unknown: Exemplary gene or splice site sequence"
uuggcaagug

SEQ ID NO: 2946 - RNA, 10 nt, Unknown
  source: /note="Description of Unknown: Exemplary gene or splice site sequence"
uuggccgagu

SEQ ID NO: 2947 - RNA, 10 nt, Unknown
  source: /note="Description of Unknown: Exemplary gene or splice site sequence"
uugguaaaaa

SEQ ID NO: 2948 - RNA, 10 nt, Unknown
  source: /note="Description of Unknown: Exemplary gene or splice site sequence"
uugguaaaau

SEQ ID NO: 2949 - RNA, 10 nt, Unknown
  source: /note="Description of Unknown: Exemplary gene or splice site sequence"
uugguaaaga

SEQ ID NO: 2950 - RNA, 10 nt, Unknown
  source: /note="Description of Unknown: Exemplary gene or splice site sequence"
uugguaaagg

SEQ ID NO: 2951 - RNA, 10 nt, Unknown
  source: /note="Description of Unknown: Exemplary gene or splice site sequence"
uugguaaagu

SEQ ID NO: 2952 - RNA, 10 nt, Unknown
  source: /note="Description of Unknown: Exemplary gene or splice site sequence"
uugguaaauc

SEQ ID NO: 2953 - RNA, 10 nt, Unknown
  source: /note="Description of Unknown: Exemplary gene or splice site sequence"
uugguaaaug

SEQ ID NO: 2954 - RNA, 10 nt, Unknown
  source: /note="Description of Unknown: Exemplary gene or splice site sequence"
uugguaaauu

SEQ ID NO: 2955 - RNA, 10 nt, Unknown
  source: /note="Description of Unknown: Exemplary gene or splice site sequence"
uugguaacug

SEQ ID NO: 2956 - RNA, 10 nt, Unknown
  source: /note="Description of Unknown: Exemplary gene or splice site sequence"
uugguaacuu

SEQ ID NO: 2957 - RNA, 10 nt, Unknown
  source: /note="Description of Unknown: Exemplary gene or splice site sequence"
uugguaagaa

SEQ ID NO: 2958 - RNA, 10 nt, Unknown
  source: /note="Description of Unknown: Exemplary gene or splice site sequence"
uugguaagag

SEQ ID NO: 2959 - RNA, 10 nt, Unknown
  source: /note="Description of Unknown: Exemplary gene or splice site sequence"
uugguaagcu

SEQ ID NO: 2960 - RNA, 10 nt, Unknown
  source: /note="Description of Unknown: Exemplary gene or splice site sequence"
uugguaagga

SEQ ID NO: 2961 - RNA, 10 nt, Unknown
  source: /note="Description of Unknown: Exemplary gene or splice site sequence"
uugguaaggg

SEQ ID NO: 2962 - RNA, 10 nt, Unknown
  source: /note="Description of Unknown: Exemplary gene or splice site sequence"
uugguaagua

SEQ ID NO: 2963 - RNA, 10 nt, Unknown
  source: /note="Description of Unknown: Exemplary gene or splice site sequence"
uugguaagug

SEQ ID NO: 2964 - RNA, 10 nt, Unknown
  source: /note="Description of Unknown: Exemplary gene or splice site sequence"
uugguaaguu

SEQ ID NO: 2965 - RNA, 10 nt, Unknown
  source: /note="Description of Unknown: Exemplary gene or splice site sequence"
uugguaauac

SEQ ID NO: 2966 - RNA, 10 nt, Unknown
  source: /note="Description of Unknown: Exemplary gene or splice site sequence"
uugguaauca

SEQ ID NO: 2967 - RNA, 10 nt, Unknown
  source: /note="Description of Unknown: Exemplary gene or splice site sequence"
uugguaaugc

SEQ ID NO: 2968 - RNA, 10 nt, Unknown
  source: /note="Description of Unknown: Exemplary gene or splice site sequence"
uugguaaugu

SEQ ID NO: 2969 - RNA, 10 nt, Unknown
  source: /note="Description of Unknown: Exemplary gene or splice site sequence"
uugguaauug

SEQ ID NO: 2970 - RNA, 10 nt, Unknown
  source: /note="Description of Unknown: Exemplary gene or splice site sequence"
uugguaauuu

SEQ ID NO: 2971 - RNA, 10 nt, Unknown
  source: /note="Description of Unknown: Exemplary gene or splice site sequence"
uugguacaua

SEQ ID NO: 2972 - RNA, 10 nt, Unknown
  source: /note="Description of Unknown: Exemplary gene or splice site sequence"
uugguacgug

SEQ ID NO: 2973 - RNA, 10 nt, Unknown
  source: /note="Description of Unknown: Exemplary gene or splice site sequence"
uugguagagg

SEQ ID NO: 2974 - RNA, 10 nt, Unknown
  source: /note="Description of Unknown: Exemplary gene or splice site sequence"
uugguaggac

SEQ ID NO: 2975 - RNA, 10 nt, Unknown
  source: /note="Description of Unknown: Exemplary gene or splice site sequence"
uugguaggcg

SEQ ID NO: 2976 - RNA, 10 nt, Unknown
  source: /note="Description of Unknown: Exemplary gene or splice site sequence"
uugguaggcu

SEQ ID NO: 2977 - RNA, 10 nt, Unknown
  source: /note="Description of Unknown: Exemplary gene or splice site sequence"
uugguaggga

SEQ ID NO: 2978 - RNA, 10 nt, Unknown
  source: /note="Description of Unknown: Exemplary gene or splice site sequence"
uugguaggua

SEQ ID NO: 2979 - RNA, 10 nt, Unknown
  source: /note="Description of Unknown: Exemplary gene or splice site sequence"
uugguagguc

SEQ ID NO: 2980 - RNA, 10 nt, Unknown
  source: /note="Description of Unknown: Exemplary gene or splice site sequence"
uugguaggug

SEQ ID NO: 2981 - RNA, 10 nt, Unknown
  source: /note="Description of Unknown: Exemplary gene or splice site sequence"
uugguauaaa

SEQ ID NO: 2982 - RNA, 10 nt, Unknown
  source: /note="Description of Unknown: Exemplary gene or splice site sequence"
uugguauaca

SEQ ID NO: 2983 - RNA, 10 nt, Unknown
  source: /note="Description of Unknown: Exemplary gene or splice site sequence"
uugguauauu

SEQ ID NO: 2984 - RNA, 10 nt, Unknown
  source: /note="Description of Unknown: Exemplary gene or splice site sequence"
uugguaucua

SEQ ID NO: 2985 - RNA, 10 nt, Unknown
  source: /note="Description of Unknown: Exemplary gene or splice site sequence"
uugguaucuc

SEQ ID NO: 2986 - RNA, 10 nt, Unknown
  source: /note="Description of Unknown: Exemplary gene or splice site sequence"
uugguaugca

SEQ ID NO: 2987 - RNA, 10 nt, Unknown
  source: /note="Description of Unknown: Exemplary gene or splice site sequence"
uugguaugua

SEQ ID NO: 2988 - RNA, 10 nt, Unknown
  source: /note="Description of Unknown: Exemplary gene or splice site sequence"
uugguaugug

SEQ ID NO: 2989 - RNA, 10 nt, Unknown
  source: /note="Description of Unknown: Exemplary gene or splice site sequence"
uugguauguu

SEQ ID NO: 2990 - RNA, 10 nt, Unknown
  source: /note="Description of Unknown: Exemplary gene or splice site sequence"
uugguauugu

SEQ ID NO: 2991 - RNA, 10 nt, Unknown
  source: /note="Description of Unknown: Exemplary gene or splice site sequence"
uugguauuua

SEQ ID NO: 2992 - RNA, 10 nt, Unknown
  source: /note="Description of Unknown: Exemplary gene or splice site sequence"
uugguauuuu

SEQ ID NO: 2993 - RNA, 10 nt, Unknown
  source: /note="Description of Unknown: Exemplary gene or splice site sequence"
uuggucagaa

SEQ ID NO: 2994 - RNA, 10 nt, Unknown
  source: /note="Description of Unknown: Exemplary gene or splice site sequence"
uuggucagua

SEQ ID NO: 2995 - RNA, 10 nt, Unknown
  source: /note="Description of Unknown: Exemplary gene or splice site sequence"
uuggucucug

SEQ ID NO: 2996 - RNA, 10 nt, Unknown
  source: /note="Description of Unknown: Exemplary gene or splice site sequence"
uuggucugca

SEQ ID NO: 2997 - RNA, 10 nt, Unknown
  source: /note="Description of Unknown: Exemplary gene or splice site sequence"
uuggugaaaa

SEQ ID NO: 2998 - RNA, 10 nt, Unknown
  source: /note="Description of Unknown: Exemplary gene or splice site sequence"
uuggugacug

SEQ ID NO: 2999 - RNA, 10 nt, Unknown
  source: /note="Description of Unknown: Exemplary gene or splice site sequence"
uuggugagac

SEQ ID NO: 3000 - RNA, 10 nt, Unknown
  source: /note="Description of Unknown: Exemplary gene or splice site sequence"
uuggugagau

SEQ ID NO: 3001 - RNA, 10 nt, Unknown
  source: /note="Description of Unknown: Exemplary gene or splice site sequence"
uuggugagca

SEQ ID NO: 3002 - RNA, 10 nt, Unknown
  source: /note="Description of Unknown: Exemplary gene or splice site sequence"
uuggugagga

SEQ ID NO: 3003 - RNA, 10 nt, Unknown
  source: /note="Description of Unknown: Exemplary gene or splice site sequence"
uuggugaggg

SEQ ID NO: 3004 - RNA, 10 nt, Unknown
  source: /note="Description of Unknown: Exemplary gene or splice site sequence"
uuggugagua

SEQ ID NO: 3005 - RNA, 10 nt, Unknown
  source: /note="Description of Unknown: Exemplary gene or splice site sequence"
uuggugaguc

SEQ ID NO: 3006 - RNA, 10 nt, Unknown
  source: /note="Description of Unknown: Exemplary gene or splice site sequence"
uuggugagug

SEQ ID NO: 3007 - RNA, 10 nt, Unknown
  source: /note="Description of Unknown: Exemplary gene or splice site sequence"
uuggugaguu

SEQ ID NO: 3008 - RNA, 10 nt, Unknown
  source: /note="Description of Unknown: Exemplary gene or splice site sequence"
uuggugaugg

SEQ ID NO: 3009 - RNA, 10 nt, Unknown
  source: /note="Description of Unknown: Exemplary gene or splice site sequence"
uuggugauua

SEQ ID NO: 3010 - RNA, 10 nt, Unknown
  source: /note="Description of Unknown: Exemplary gene or splice site sequence"
uuggugauug

SEQ ID NO: 3011 - RNA, 10 nt, Unknown
  source: /note="Description of Unknown: Exemplary gene or splice site sequence"
uuggugcaca

SEQ ID NO: 3012 - RNA, 10 nt, Unknown
  source: /note="Description of Unknown: Exemplary gene or splice site sequence"
uuggugggaa

SEQ ID NO: 3013 - RNA, 10 nt, Unknown
  source: /note="Description of Unknown: Exemplary gene or splice site sequence"
uugguggggc

SEQ ID NO: 3014 - RNA, 10 nt, Unknown
  source: /note="Description of Unknown: Exemplary gene or splice site sequence"
uuggugggua

SEQ ID NO: 3015 - RNA, 10 nt, Unknown
  source: /note="Description of Unknown: Exemplary gene or splice site sequence"
uugguggguc

SEQ ID NO: 3016 - RNA, 10 nt, Unknown
  source: /note="Description of Unknown: Exemplary gene or splice site sequence"
uuggugggug

SEQ ID NO: 3017 - RNA, 10 nt, Unknown
  source: /note="Description of Unknown: Exemplary gene or splice site sequence"
uugguggguu

SEQ ID NO: 3018 - RNA, 10 nt, Unknown
  source: /note="Description of Unknown: Exemplary gene or splice site sequence"
uugguguggu

SEQ ID NO: 3019 - RNA, 10 nt, Unknown
  source: /note="Description of Unknown: Exemplary gene or splice site sequence"
uugguguguc

SEQ ID NO: 3020 - RNA, 10 nt, Unknown
  source: /note="Description of Unknown: Exemplary gene or splice site sequence"
uuggugugug

SEQ ID NO: 3021 - RNA, 10 nt, Unknown
  source: /note="Description of Unknown: Exemplary gene or splice site sequence"
uugguguguu

SEQ ID NO: 3022 - RNA, 10 nt, Unknown
  source: /note="Description of Unknown: Exemplary gene or splice site sequence"
uugguuaagu

SEQ ID NO: 3023 - RNA, 10 nt, Unknown
  source: /note="Description of Unknown: Exemplary gene or splice site sequence"
uugguuagca

SEQ ID NO: 3024 - RNA, 10 nt, Unknown
  source: /note="Description of Unknown: Exemplary gene or splice site sequence"
uugguuagug

SEQ ID NO: 3025 - RNA, 10 nt, Unknown
  source: /note="Description of Unknown: Exemplary gene or splice site sequence"
uugguuaguu

SEQ ID NO: 3026 - RNA, 10 nt, Unknown
  source: /note="Description of Unknown: Exemplary gene or splice site sequence"
uugguuggga

SEQ ID NO: 3027 - RNA, 10 nt, Unknown
  source: /note="Description of Unknown: Exemplary gene or splice site sequence"
uugguugguu

SEQ ID NO: 3028 - RNA, 10 nt, Unknown
  source: /note="Description of Unknown: Exemplary gene or splice site sequence"
uugguuugua

SEQ ID NO: 3029 - RNA, 10 nt, Unknown
  source: /note="Description of Unknown: Exemplary gene or splice site sequence"
uugguuuguc

SEQ ID NO: 3030 - RNA, 10 nt, Unknown
  source: /note="Description of Unknown: Exemplary gene or splice site sequence"
uuugcaagug

SEQ ID NO: 3031 - RNA, 10 nt, Unknown
  source: /note="Description of Unknown: Exemplary gene or splice site sequence"
uuuguaaaua

SEQ ID NO: 3032 - RNA, 10 nt, Unknown
  source: /note="Description of Unknown: Exemplary gene or splice site sequence"
uuuguaaaug

SEQ ID NO: 3033 - RNA, 10 nt, Unknown
  source: /note="Description of Unknown: Exemplary gene or splice site sequence"
uuuguaagaa

SEQ ID NO: 3034 - RNA, 10 nt, Unknown
  source: /note="Description of Unknown: Exemplary gene or splice site sequence"
uuuguaagac

SEQ ID NO: 3035 - RNA, 10 nt, Unknown
  source: /note="Description of Unknown: Exemplary gene or splice site sequence"
uuuguaagag

SEQ ID NO: 3036 - RNA, 10 nt, Unknown
  source: /note="Description of Unknown: Exemplary gene or splice site sequence"
uuuguaagca

SEQ ID NO: 3037 - RNA, 10 nt, Unknown
  source: /note="Description of Unknown: Exemplary gene or splice site sequence"
uuuguaaggu

SEQ ID NO: 3038 - RNA, 10 nt, Unknown
  source: /note="Description of Unknown: Exemplary gene or splice site sequence"
uuuguaagua

SEQ ID NO: 3039 - RNA, 10 nt, Unknown
  source: /note="Description of Unknown: Exemplary gene or splice site sequence"
uuuguaaguc

SEQ ID NO: 3040 - RNA, 10 nt, Unknown
  source: /note="Description of Unknown: Exemplary gene or splice site sequence"
uuuguaagug

SEQ ID NO: 3041 - RNA, 10 nt, Unknown
  source: /note="Description of Unknown: Exemplary gene or splice site sequence"
uuuguaaguu

SEQ ID NO: 3042 - RNA, 10 nt, Unknown
  source: /note="Description of Unknown: Exemplary gene or splice site sequence"
uuuguaauuu

SEQ ID NO: 3043 - RNA, 10 nt, Unknown
  source: /note="Description of Unknown: Exemplary gene or splice site sequence"
uuuguacagg

SEQ ID NO: 3044 - RNA, 10 nt, Unknown
  source: /note="Description of Unknown: Exemplary gene or splice site sequence"
uuuguacgug

SEQ ID NO: 3045 - RNA, 10 nt, Unknown
  source: /note="Description of Unknown: Exemplary gene or splice site sequence"
uuuguacuag

SEQ ID NO: 3046 - RNA, 10 nt, Unknown
  source: /note="Description of Unknown: Exemplary gene or splice site sequence"
uuuguacugu

SEQ ID NO: 3047 - RNA, 10 nt, Unknown
  source: /note="Description of Unknown: Exemplary gene or splice site sequence"
uuuguagguu

SEQ ID NO: 3048 - RNA, 10 nt, Unknown
  source: /note="Description of Unknown: Exemplary gene or splice site sequence"
uuuguauccu

SEQ ID NO: 3049 - RNA, 10 nt, Unknown
  source: /note="Description of Unknown: Exemplary gene or splice site sequence"
uuuguauguu

SEQ ID NO: 3050 - RNA, 10 nt, Unknown
  source: /note="Description of Unknown: Exemplary gene or splice site sequence"
uuugugagca

SEQ ID NO: 3051 - RNA, 10 nt, Unknown
  source: /note="Description of Unknown: Exemplary gene or splice site sequence"
uuugugagug

SEQ ID NO: 3052 - RNA, 10 nt, Unknown
  source: /note="Description of Unknown: Exemplary gene or splice site sequence"
uuugugcguc

SEQ ID NO: 3053 - RNA, 10 nt, Unknown
  source: /note="Description of Unknown: Exemplary gene or splice site sequence"
uuuguguguc

SEQ ID NO: 3054 - RNA, 10 nt, Unknown
  source: /note="Description of Unknown: Exemplary gene or splice site sequence"
uggguaccug

SEQ ID NO: 3055 - RNA, 10 nt, Unknown
  source: /note="Description of Unknown: Exemplary gene or splice site sequence"
aagguuagag

SEQ ID NO: 3056 - RNA, 10 nt, Unknown
  source: /note="Description of Unknown: Exemplary gene or splice site sequence"
auggcacuua

SEQ ID NO: 3057 - RNA, 10 nt, Unknown
  source: /note="Description of Unknown: Exemplary gene or splice site sequence"
ugggugagcu

SEQ ID NO: 3058 - RNA, 10 nt, Unknown
  source: /note="Description of Unknown: Exemplary gene or splice site sequence"
cgagcugggc

SEQ ID NO: 3059 - RNA, 10 nt, Unknown
  source: /note="Description of Unknown: Exemplary gene or splice site sequence"
aaagcacccc

SEQ ID NO: 3060 - RNA, 10 nt, Unknown
  source: /note="Description of Unknown: Exemplary gene or splice site sequence"
uagguggggg

SEQ ID NO: 3061 - RNA, 10 nt, Unknown
  source: /note="Description of Unknown: Exemplary gene or splice site sequence"
agaguaacgu

SEQ ID NO: 3062 - RNA, 10 nt, Unknown
  source: /note="Description of Unknown: Exemplary gene or splice site sequence"
ucggugaugu

SEQ ID NO: 3063 - RNA, 10 nt, Unknown
  source: /note="Description of Unknown: Exemplary gene or splice site sequence"
agggucugag

SEQ ID NO: 3064 - RNA, 10 nt, Unknown
  source: /note="Description of Unknown: Exemplary gene or splice site sequence"
gaggugacug

SEQ ID NO: 3065 - RNA, 10 nt, Unknown
  source: /note="Description of Unknown: Exemplary gene or splice site sequence"
augguagguu

SEQ ID NO: 3066 - RNA, 10 nt, Unknown
  source: /note="Description of Unknown: Exemplary gene or splice site sequence"
caaguacugc

SEQ ID NO: 3067 - RNA, 10 nt, Unknown
  source: /note="Description of Unknown: Exemplary gene or splice site sequence"
cacgugcgua

SEQ ID NO: 3068 - RNA, 10 nt, Unknown
  source: /note="Description of Unknown: Exemplary gene or splice site sequence"
ccggugagcu

SEQ ID NO: 3069 - RNA, 10 nt, Unknown
  source: /note="Description of Unknown: Exemplary gene or splice site sequence"
cagguacuuc

SEQ ID NO: 3070 - RNA, 10 nt, Unknown
  source: /note="Description of Unknown: Exemplary gene or splice site sequence"
gaagcaagua

SEQ ID NO: 3071 - RNA, 10 nt, Unknown
  source: /note="Description of Unknown: Exemplary gene or splice site sequence"
caggcaaguc

SEQ ID NO: 3072 - RNA, 10 nt, Unknown
  source: /note="Description of Unknown: Exemplary gene or splice site sequence"
ccaguugggu

SEQ ID NO: 3073 - RNA, 10 nt, Unknown
  source: /note="Description of Unknown: Exemplary gene or splice site sequence"
aagguguggg

SEQ ID NO: 3074 - RNA, 10 nt, Unknown
  source: /note="Description of Unknown: Exemplary gene or splice site sequence"
ccgguaugaa

SEQ ID NO: 3075 - RNA, 10 nt, Unknown
  source: /note="Description of Unknown: Exemplary gene or splice site sequence"
agaguaauag

SEQ ID NO: 3076 - RNA, 10 nt, Unknown
  source: /note="Description of Unknown: Exemplary gene or splice site sequence"
cucguaugcc

SEQ ID NO: 3077 - RNA, 10 nt, Unknown
  source: /note="Description of Unknown: Exemplary gene or splice site sequence"
uaggcaaguu

SEQ ID NO: 3078 - RNA, 10 nt, Unknown
  source: /note="Description of Unknown: Exemplary gene or splice site sequence"
ggaguuaagu

SEQ ID NO: 3079 - RNA, 10 nt, Unknown
  source: /note="Description of Unknown: Exemplary gene or splice site sequence"
aagguuggcu

SEQ ID NO: 3080 - RNA, 10 nt, Unknown
  source: /note="Description of Unknown: Exemplary gene or splice site sequence"
ugaguaugug

SEQ ID NO: 3081 - RNA, 10 nt, Unknown
  source: /note="Description of Unknown: Exemplary gene or splice site sequence"
ccagccuucc

SEQ ID NO: 3082 - RNA, 10 nt, Unknown
  source: /note="Description of Unknown: Exemplary gene or splice site sequence"
ccuguacgug

SEQ ID NO: 3083 - RNA, 10 nt, Unknown
  source: /note="Description of Unknown: Exemplary gene or splice site sequence"
cagguacgcu

SEQ ID NO: 3084 - RNA, 10 nt, Unknown
  source: /note="Description of Unknown: Exemplary gene or splice site sequence"
gagguucuuc

SEQ ID NO: 3085 - RNA, 10 nt, Unknown
  source: /note="Description of Unknown: Exemplary gene or splice site sequence"
aagguugccu

SEQ ID NO: 3086 - RNA, 10 nt, Unknown
  source: /note="Description of Unknown: Exemplary gene or splice site sequence"
cguguucacu

SEQ ID NO: 3087 - RNA, 10 nt, Unknown
  source: /note="Description of Unknown: Exemplary gene or splice site sequence"
cgggugggga

SEQ ID NO: 3088 - RNA, 10 nt, Unknown
  source: /note="Description of Unknown: Exemplary gene or splice site sequence"
cggguaagga

SEQ ID NO: 3089 - RNA, 10 nt, Unknown
  source: /note="Description of Unknown: Exemplary gene or splice site sequence"
acgguagagc

SEQ ID NO: 3090 - RNA, 10 nt, Unknown
  source: /note="Description of Unknown: Exemplary gene or splice site sequence"
gcgguaagag

SEQ ID NO: 3091 - RNA, 10 nt, Unknown
  source: /note="Description of Unknown: Exemplary gene or splice site sequence"
cagguguugu

SEQ ID NO: 3092 - RNA, 10 nt, Unknown
  source: /note="Description of Unknown: Exemplary gene or splice site sequence"
gaaguuugug

SEQ ID NO: 3093 - RNA, 10 nt, Unknown
  source: /note="Description of Unknown: Exemplary gene or splice site sequence"
cggguucgug

SEQ ID NO: 3094 - RNA, 10 nt, Unknown
  source: /note="Description of Unknown: Exemplary gene or splice site sequence"
auuguccggc

SEQ ID NO: 3095 - RNA, 10 nt, Unknown
  source: /note="Description of Unknown: Exemplary gene or splice site sequence"
gaugugugug

SEQ ID NO: 3096 - RNA, 10 nt, Unknown
  source: /note="Description of Unknown: Exemplary gene or splice site sequence"
auggucuguu

SEQ ID NO: 3097 - RNA, 10 nt, Unknown
  source: /note="Description of Unknown: Exemplary gene or splice site sequence"
aguguaagga

SEQ ID NO: 3098 - RNA, 10 nt, Unknown
  source: /note="Description of Unknown: Exemplary gene or splice site sequence"
aaggugaaga

SEQ ID NO: 3099 - RNA, 10 nt, Unknown
  source: /note="Description of Unknown: Exemplary gene or splice site sequence"
uaggugagcg

SEQ ID NO: 3100 - RNA, 10 nt, Unknown
  source: /note="Description of Unknown: Exemplary gene or splice site sequence"
gccguaaguu

SEQ ID NO: 3101 - RNA, 10 nt, Unknown
  source: /note="Description of Unknown: Exemplary gene or splice site sequence"
acagcccaug

SEQ ID NO: 3102 - RNA, 10 nt, Unknown
  source: /note="Description of Unknown: Exemplary gene or splice site sequence"
gcggugagcc

SEQ ID NO: 3103 - RNA, 10 nt, Unknown
  source: /note="Description of Unknown: Exemplary gene or splice site sequence"
augguaccua

SEQ ID NO: 3104 - RNA, 10 nt, Unknown
  source: /note="Description of Unknown: Exemplary gene or splice site sequence"
augguggugc

SEQ ID NO: 3105 - RNA, 10 nt, Unknown
  source: /note="Description of Unknown: Exemplary gene or splice site sequence"
uaaguggcag

SEQ ID NO: 3106 - RNA, 10 nt, Unknown
  source: /note="Description of Unknown: Exemplary gene or splice site sequence"
uagguauagu

SEQ ID NO: 3107 - RNA, 10 nt, Unknown
  source: /note="Description of Unknown: Exemplary gene or splice site sequence"
cugguauuua

SEQ ID NO: 3108 - RNA, 10 nt, Unknown
  source: /note="Description of Unknown: Exemplary gene or splice site sequence"
aggguaaacg

SEQ ID NO: 3109 - RNA, 10 nt, Unknown
  source: /note="Description of Unknown: Exemplary gene or splice site sequence"
uugguacuga

SEQ ID NO: 3110 - RNA, 10 nt, Unknown
  source: /note="Description of Unknown: Exemplary gene or splice site sequence"
gagguggaua

SEQ ID NO: 3111 - RNA, 10 nt, Unknown
  source: /note="Description of Unknown: Exemplary gene or splice site sequence"
gauguaagaa

SEQ ID NO: 3112 - RNA, 10 nt, Unknown
  source: /note="Description of Unknown: Exemplary gene or splice site sequence"
acggucaguu

SEQ ID NO: 3113 - RNA, 10 nt, Unknown
  source: /note="Description of Unknown: Exemplary gene or splice site sequence"
uaaguaaaca

SEQ ID NO: 3114 - RNA, 10 nt, Unknown
  source: /note="Description of Unknown: Exemplary gene or splice site sequence"
aggguauuug

SEQ ID NO: 3115 - RNA, 10 nt, Unknown
  source: /note="Description of Unknown: Exemplary gene or splice site sequence"
caggugccac

SEQ ID NO: 3116 - RNA, 10 nt, Unknown
  source: /note="Description of Unknown: Exemplary gene or splice site sequence"
aauguacagg

SEQ ID NO: 3117 - RNA, 10 nt, Unknown
  source: /note="Description of Unknown: Exemplary gene or splice site sequence"
aguguaggug

SEQ ID NO: 3118 - RNA, 10 nt, Unknown
  source: /note="Description of Unknown: Exemplary gene or splice site sequence"
gagguaacuc

SEQ ID NO: 3119 - RNA, 10 nt, Unknown
  source: /note="Description of Unknown: Exemplary gene or splice site sequence"
gagguggcgc

SEQ ID NO: 3120 - RNA, 10 nt, Unknown
  source: /note="Description of Unknown: Exemplary gene or splice site sequence"
cugguaauug

SEQ ID NO: 3121 - RNA, 10 nt, Unknown
  source: /note="Description of Unknown: Exemplary gene or splice site sequence"
gagguuugcu

SEQ ID NO: 3122 - RNA, 10 nt, Unknown
  source: /note="Description of Unknown: Exemplary gene or splice site sequence"
uguguacgug

SEQ ID NO: 3123 - RNA, 10 nt, Unknown
  source: /note="Description of Unknown: Exemplary gene or splice site sequence"
cuaguaggca

SEQ ID NO: 3124 - RNA, 10 nt, Unknown
  source: /note="Description of Unknown: Exemplary gene or splice site sequence"
ucuguaaggc

SEQ ID NO: 3125 - RNA, 10 nt, Unknown
  source: /note="Description of Unknown: Exemplary gene or splice site sequence"
aagguaacca

SEQ ID NO: 3126 - RNA, 10 nt, Unknown
  source: /note="Description of Unknown: Exemplary gene or splice site sequence"
aacguaggac

SEQ ID NO: 3127 - RNA, 10 nt, Unknown
  source: /note="Description of Unknown: Exemplary gene or splice site sequence"
guagcaggua

SEQ ID NO: 3128 - RNA, 10 nt, Unknown
  source: /note="Description of Unknown: Exemplary gene or splice site sequence"
gaggucagac

SEQ ID NO: 3129 - RNA, 10 nt, Unknown
  source: /note="Description of Unknown: Exemplary gene or splice site sequence"
aggguaugaa

SEQ ID NO: 3130 - RNA, 10 nt, Unknown
  source: /note="Description of Unknown: Exemplary gene or splice site sequence"
caggcacgug

SEQ ID NO: 3131 - RNA, 10 nt, Unknown
  source: /note="Description of Unknown: Exemplary gene or splice site sequence"
ggggcaagac

SEQ ID NO: 3132 - RNA, 10 nt, Unknown
  source: /note="Description of Unknown: Exemplary gene or splice site sequence"
aaggcaaggu

SEQ ID NO: 3133 - RNA, 10 nt, Unknown
  source: /note="Description of Unknown: Exemplary gene or splice site sequence"
uuggugagaa

SEQ ID NO: 3134 - RNA, 10 nt, Unknown
  source: /note="Description of Unknown: Exemplary gene or splice site sequence"
gacgugaguc

SEQ ID NO: 3135 - RNA, 10 nt, Unknown
  source: /note="Description of Unknown: Exemplary gene or splice site sequence"
uauguaugcu

SEQ ID NO: 3136 - RNA, 10 nt, Unknown
  source: /note="Description of Unknown: Exemplary gene or splice site sequence"
caggugaacu

SEQ ID NO: 3137 - RNA, 10 nt, Unknown
  source: /note="Description of Unknown: Exemplary gene or splice site sequence"
cacguaaaug

SEQ ID NO: 3138 - RNA, 10 nt, Unknown
  source: /note="Description of Unknown: Exemplary gene or splice site sequence"
aaggugugau

SEQ ID NO: 3139 - RNA, 10 nt, Unknown
  source: /note="Description of Unknown: Exemplary gene or splice site sequence"
gaaguauuug

SEQ ID NO: 3140 - RNA, 10 nt, Unknown
  source: /note="Description of Unknown: Exemplary gene or splice site sequence"
aaggucugug

SEQ ID NO: 3141 - RNA, 10 nt, Unknown
  source: /note="Description of Unknown: Exemplary gene or splice site sequence"
aagguggagg

SEQ ID NO: 3142 - RNA, 10 nt, Unknown
  source: /note="Description of Unknown: Exemplary gene or splice site sequence"
aaaguucugu

SEQ ID NO: 3143 - RNA, 10 nt, Unknown
  source: /note="Description of Unknown: Exemplary gene or splice site sequence"
auugugagga

SEQ ID NO: 3144 - RNA, 10 nt, Unknown
  source: /note="Description of Unknown: Exemplary gene or splice site sequence"
cagguuggaa

SEQ ID NO: 3145 - RNA, 10 nt, Unknown
  source: /note="Description of Unknown: Exemplary gene or splice site sequence"
cuggucacuu

SEQ ID NO: 3146 - RNA, 10 nt, Unknown
  source: /note="Description of Unknown: Exemplary gene or splice site sequence"
aggguaggau

SEQ ID NO: 3147 - RNA, 10 nt, Unknown
  source: /note="Description of Unknown: Exemplary gene or splice site sequence"
aauguguguu

SEQ ID NO: 3148 - RNA, 10 nt, Unknown
  source: /note="Description of Unknown: Exemplary gene or splice site sequence"
aaggcgggcu

SEQ ID NO: 3149 - RNA, 10 nt, Unknown
  source: /note="Description of Unknown: Exemplary gene or splice site sequence"
auagcaagua

SEQ ID NO: 3150 - RNA, 10 nt, Unknown
  source: /note="Description of Unknown: Exemplary gene or splice site sequence"
caagcaaggc

SEQ ID NO: 3151 - RNA, 10 nt, Unknown
  source: /note="Description of Unknown: Exemplary gene or splice site sequence"
gugguaauua

SEQ ID NO: 3152 - RNA, 10 nt, Unknown
  source: /note="Description of Unknown: Exemplary gene or splice site sequence"
ucuguucagu

SEQ ID NO: 3153 - RNA, 10 nt, Unknown
  source: /note="Description of Unknown: Exemplary gene or splice site sequence"
aagguaucau

SEQ ID NO: 3154 - RNA, 10 nt, Unknown
  source: /note="Description of Unknown: Exemplary gene or splice site sequence"
uaaguuggca

SEQ ID NO: 3155 - RNA, 10 nt, Unknown
  source: /note="Description of Unknown: Exemplary gene or splice site sequence"
agugugaggc

SEQ ID NO: 3156 - RNA, 10 nt, Unknown
  source: /note="Description of Unknown: Exemplary gene or splice site sequence"
gagguuugug

SEQ ID NO: 3157 - RNA, 10 nt, Unknown
  source: /note="Description of Unknown: Exemplary gene or splice site sequence"
ugggucugcu

SEQ ID NO: 3158 - RNA, 10 nt, Unknown
  source: /note="Description of Unknown: Exemplary gene or splice site sequence"
caggugcagu

SEQ ID NO: 3159 - RNA, 10 nt, Unknown
  source: /note="Description of Unknown: Exemplary gene or splice site sequence"
aagguggagu

SEQ ID NO: 3160 - RNA, 10 nt, Unknown
  source: /note="Description of Unknown: Exemplary gene or splice site sequence"
ggggucaguu

SEQ ID NO: 3161 - RNA, 10 nt, Unknown
  source: /note="Description of Unknown: Exemplary gene or splice site sequence"
gggguagggu

SEQ ID NO: 3162 - RNA, 10 nt, Unknown
  source: /note="Description of Unknown: Exemplary gene or splice site sequence"
aaggccagca

SEQ ID NO: 3163 - RNA, 10 nt, Unknown
  source: /note="Description of Unknown: Exemplary gene or splice site sequence"
cgaguaugcc

SEQ ID NO: 3164 - RNA, 10 nt, Unknown
  source: /note="Description of Unknown: Exemplary gene or splice site sequence"
guggugagcg

SEQ ID NO: 3165 - RNA, 10 nt, Unknown
  source: /note="Description of Unknown: Exemplary gene or splice site sequence"
gguguaugaa

SEQ ID NO: 3166 - RNA, 10 nt, Unknown
  source: /note="Description of Unknown: Exemplary gene or splice site sequence"
agggcgaguu

SEQ ID NO: 3167 - RNA, 10 nt, Unknown
  source: /note="Description of Unknown: Exemplary gene or splice site sequence"
cagguuuugc

SEQ ID NO: 3168 - RNA, 10 nt, Unknown
  source: /note="Description of Unknown: Exemplary gene or splice site sequence"
uuugugaguu

SEQ ID NO: 3169 - RNA, 10 nt, Unknown
  source: /note="Description of Unknown: Exemplary gene or splice site sequence"
gagguccucu

SEQ ID NO: 3170 - RNA, 10 nt, Unknown
  source: /note="Description of Unknown: Exemplary gene or splice site sequence"
ccagcaggua

SEQ ID NO: 3171 - RNA, 10 nt, Unknown
  source: /note="Description of Unknown: Exemplary gene or splice site sequence"
gagguucgcg

SEQ ID NO: 3172 - RNA, 10 nt, Unknown
  source: /note="Description of Unknown: Exemplary gene or splice site sequence"
caggcaaaua

SEQ ID NO: 3173 - RNA, 10 nt, Unknown
  source: /note="Description of Unknown: Exemplary gene or splice site sequence"
cagguuaaau

SEQ ID NO: 3174 - RNA, 10 nt, Unknown
  source: /note="Description of Unknown: Exemplary gene or splice site sequence"
uugguaauaa

SEQ ID NO: 3175 - RNA, 10 nt, Unknown
  source: /note="Description of Unknown: Exemplary gene or splice site sequence"
uauguaggua

SEQ ID NO: 3176 - RNA, 10 nt, Unknown
  source: /note="Description of Unknown: Exemplary gene or splice site sequence"
aaggugugcc

SEQ ID NO: 3177 - RNA, 10 nt, Unknown
  source: /note="Description of Unknown: Exemplary gene or splice site sequence"
caggcaagca

SEQ ID NO: 3178 - RNA, 10 nt, Unknown
  source: /note="Description of Unknown: Exemplary gene or splice site sequence"
acgguaaaug

SEQ ID NO: 3179 - RNA, 10 nt, Unknown
  source: /note="Description of Unknown: Exemplary gene or splice site sequence"
gcugugagca

SEQ ID NO: 3180 - RNA, 10 nt, Unknown
  source: /note="Description of Unknown: Exemplary gene or splice site sequence"
augguacaca

SEQ ID NO: 3181 - RNA, 10 nt, Unknown
  source: /note="Description of Unknown: Exemplary gene or splice site sequence"
guaguguguu

SEQ ID NO: 3182 - RNA, 10 nt, Unknown
  source: /note="Description of Unknown: Exemplary gene or splice site sequence"
acuguaagag

SEQ ID NO: 3183 - RNA, 10 nt, Unknown
  source: /note="Description of Unknown: Exemplary gene or splice site sequence"
cccgcagguc

SEQ ID NO: 3184 - RNA, 10 nt, Unknown
  source: /note="Description of Unknown: Exemplary gene or splice site sequence"
gaggugcugu

SEQ ID NO: 3185 - RNA, 10 nt, Unknown
  source: /note="Description of Unknown: Exemplary gene or splice site sequence"
uaaguaugcu

SEQ ID NO: 3186 - RNA, 10 nt, Unknown
  source: /note="Description of Unknown: Exemplary gene or splice site sequence"
gaggccaucu

SEQ ID NO: 3187 - RNA, 10 nt, Unknown
  source: /note="Description of Unknown: Exemplary gene or splice site sequence"
caggugcuac

SEQ ID NO: 3188 - RNA, 10 nt, Unknown
  source: /note="Description of Unknown: Exemplary gene or splice site sequence"
gaggugugaa

SEQ ID NO: 3189 - RNA, 10 nt, Unknown
  source: /note="Description of Unknown: Exemplary gene or splice site sequence"
guggcgcgcg

SEQ ID NO: 3190 - RNA, 10 nt, Unknown
  source: /note="Description of Unknown: Exemplary gene or splice site sequence"
uaaguggagg

SEQ ID NO: 3191 - RNA, 10 nt, Unknown
  source: /note="Description of Unknown: Exemplary gene or splice site sequence"
caugugggua

SEQ ID NO: 3192 - RNA, 10 nt, Unknown
  source: /note="Description of Unknown: Exemplary gene or splice site sequence"
gagguagggu

SEQ ID NO: 3193 - RNA, 10 nt, Unknown
  source: /note="Description of Unknown: Exemplary gene or splice site sequence"
aggguucuag

SEQ ID NO: 3194 - RNA, 10 nt, Unknown
  source: /note="Description of Unknown: Exemplary gene or splice site sequence"
ugugugagcu

SEQ ID NO: 3195 - RNA, 10 nt, Unknown
  source: /note="Description of Unknown: Exemplary gene or splice site sequence"
agggugaauc

SEQ ID NO: 3196 - RNA, 10 nt, Unknown
  source: /note="Description of Unknown: Exemplary gene or splice site sequence"
caggucaggg

SEQ ID NO: 3197 - RNA, 10 nt, Unknown
  source: /note="Description of Unknown: Exemplary gene or splice site sequence"
aaggucccug

SEQ ID NO: 3198 - RNA, 10 nt, Unknown
  source: /note="Description of Unknown: Exemplary gene or splice site sequence"
cugguagagu

SEQ ID NO: 3199 - RNA, 10 nt, Unknown
  source: /note="Description of Unknown: Exemplary gene or splice site sequence"
caggugcuuu

SEQ ID NO: 3200 - RNA, 10 nt, Unknown
  source: /note="Description of Unknown: Exemplary gene or splice site sequence"
ggggugcacg

SEQ ID NO: 3201 - RNA, 10 nt, Unknown
  source: /note="Description of Unknown: Exemplary gene or splice site sequence"
acugugcuac

SEQ ID NO: 3202 - RNA, 10 nt, Unknown
  source: /note="Description of Unknown: Exemplary gene or splice site sequence"
cagguaccua

SEQ ID NO: 3203 - RNA, 10 nt, Unknown
  source: /note="Description of Unknown: Exemplary gene or splice site sequence"
aggguaaucu

SEQ ID NO: 3204 - RNA, 10 nt, Unknown
  source: /note="Description of Unknown: Exemplary gene or splice site sequence"
agggcacuug

SEQ ID NO: 3205 - RNA, 10 nt, Unknown
  source: /note="Description of Unknown: Exemplary gene or splice site sequence"
gagguaaugc

SEQ ID NO: 3206 - RNA, 10 nt, Unknown
  source: /note="Description of Unknown: Exemplary gene or splice site sequence"
ccagugaguu

SEQ ID NO: 3207 - RNA, 10 nt, Unknown
  source: /note="Description of Unknown: Exemplary gene or splice site sequence"
cuggugaauc

SEQ ID NO: 3208 - RNA, 10 nt, Unknown
  source: /note="Description of Unknown: Exemplary gene or splice site sequence"
ccugcaggug

SEQ ID NO: 3209 - RNA, 10 nt, Unknown
  source: /note="Description of Unknown: Exemplary gene or splice site sequence"
gaggugaggu

SEQ ID NO: 3210 - RNA, 10 nt, Unknown
  source: /note="Description of Unknown: Exemplary gene or splice site sequence"
cugguaaaac

SEQ ID NO: 3211 - RNA, 10 nt, Unknown
  source: /note="Description of Unknown: Exemplary gene or splice site sequence"
ugugugugcu

SEQ ID NO: 3212 - RNA, 10 nt, Unknown
  source: /note="Description of Unknown: Exemplary gene or splice site sequence"
cagguuaagu

SEQ ID NO: 3213 - RNA, 10 nt, Unknown
  source: /note="Description of Unknown: Exemplary gene or splice site sequence"
uagguauuug

SEQ ID NO: 3214 - RNA, 10 nt, Unknown
  source: /note="Description of Unknown: Exemplary gene or splice site sequence"
agcgugcgug

SEQ ID NO: 3215 - RNA, 10 nt, Unknown
  source: /note="Description of Unknown: Exemplary gene or splice site sequence"
ggggugggca

SEQ ID NO: 3216 - RNA, 10 nt, Unknown
  source: /note="Description of Unknown: Exemplary gene or splice site sequence"
cugguuguua

SEQ ID NO: 3217 - RNA, 10 nt, Unknown
  source: /note="Description of Unknown: Exemplary gene or splice site sequence"
cagguaauag

SEQ ID NO: 3218 - RNA, 10 nt, Unknown
  source: /note="Description of Unknown: Exemplary gene or splice site sequence"
uaggugaguu

SEQ ID NO: 3219 - RNA, 10 nt, Unknown
  source: /note="Description of Unknown: Exemplary gene or splice site sequence"
uagguaaucc

SEQ ID NO: 3220 - RNA, 10 nt, Unknown
  source: /note="Description of Unknown: Exemplary gene or splice site sequence"
ccggugacug

SEQ ID NO: 3221 - RNA, 10 nt, Unknown
  source: /note="Description of Unknown: Exemplary gene or splice site sequence"
gucgugauua

SEQ ID NO: 3222 - RNA, 10 nt, Unknown
  source: /note="Description of Unknown: Exemplary gene or splice site sequence"
uagguaguca

SEQ ID NO: 3223 - RNA, 10 nt, Unknown
  source: /note="Description of Unknown: Exemplary gene or splice site sequence"
cugguaaguc

SEQ ID NO: 3224 - RNA, 10 nt, Unknown
  source: /note="Description of Unknown: Exemplary gene or splice site sequence"
agggugagcg

SEQ ID NO: 3225 - RNA, 10 nt, Unknown
  source: /note="Description of Unknown: Exemplary gene or splice site sequence"
auugugacca

SEQ ID NO: 3226 - RNA, 10 nt, Unknown
  source: /note="Description of Unknown: Exemplary gene or splice site sequence"
cuagcaagug

SEQ ID NO: 3227 - RNA, 10 nt, Unknown
  source: /note="Description of Unknown: Exemplary gene or splice site sequence"
cuggugagau

SEQ ID NO: 3228 - RNA, 10 nt, Unknown
  source: /note="Description of Unknown: Exemplary gene or splice site sequence"
auggcucgag

SEQ ID NO: 3229 - RNA, 10 nt, Unknown
  source: /note="Description of Unknown: Exemplary gene or splice site sequence"
uuggugugua

SEQ ID NO: 3230 - RNA, 10 nt, Unknown
  source: /note="Description of Unknown: Exemplary gene or splice site sequence"
gaggugucug

SEQ ID NO: 3231 - RNA, 10 nt, Unknown
  source: /note="Description of Unknown: Exemplary gene or splice site sequence"
gaggugggac

SEQ ID NO: 3232 - RNA, 10 nt, Unknown
  source: /note="Description of Unknown: Exemplary gene or splice site sequence"
ggggugggag

SEQ ID NO: 3233 - RNA, 10 nt, Unknown
  source: /note="Description of Unknown: Exemplary gene or splice site sequence"
gcagcgugag

SEQ ID NO: 3234 - RNA, 10 nt, Unknown
  source: /note="Description of Unknown: Exemplary gene or splice site sequence"
cugguaugag

SEQ ID NO: 3235 - RNA, 10 nt, Unknown
  source: /note="Description of Unknown: Exemplary gene or splice site sequence"
aacguaaaau

SEQ ID NO: 3236 - RNA, 10 nt, Unknown
  source: /note="Description of Unknown: Exemplary gene or splice site sequence"
cuuguaagca

SEQ ID NO: 3237 - RNA, 10 nt, Unknown
  source: /note="Description of Unknown: Exemplary gene or splice site sequence"
auuguaagcc

SEQ ID NO: 3238 - RNA, 10 nt, Unknown
  source: /note="Description of Unknown: Exemplary gene or splice site sequence"
caaguaugga

SEQ ID NO: 3239 - RNA, 10 nt, Unknown
  source: /note="Description of Unknown: Exemplary gene or splice site sequence"
gaggucaugc

SEQ ID NO: 3240 - RNA, 10 nt, Unknown
  source: /note="Description of Unknown: Exemplary gene or splice site sequence"
acagugagac

SEQ ID NO: 3241 - RNA, 10 nt, Unknown
  source: /note="Description of Unknown: Exemplary gene or splice site sequence"
caggucugau

SEQ ID NO: 3242 - RNA, 10 nt, Unknown
  source: /note="Description of Unknown: Exemplary gene or splice site sequence"
gaaguugggu

SEQ ID NO: 3243 - RNA, 10 nt, Unknown
  source: /note="Description of Unknown: Exemplary gene or splice site sequence"
ggaguaaggc

SEQ ID NO: 3244 - RNA, 10 nt, Unknown
  source: /note="Description of Unknown: Exemplary gene or splice site sequence"
aaggucauuu

SEQ ID NO: 3245 - RNA, 10 nt, Unknown
  source: /note="Description of Unknown: Exemplary gene or splice site sequence"
cagguagucu

SEQ ID NO: 3246 - RNA, 10 nt, Unknown
  source: /note="Description of Unknown: Exemplary gene or splice site sequence"
augguaucug

SEQ ID NO: 3247 - RNA, 10 nt, Unknown
  source: /note="Description of Unknown: Exemplary gene or splice site sequence"
aaaguaaagc

SEQ ID NO: 3248 - RNA, 10 nt, Unknown
  source: /note="Description of Unknown: Exemplary gene or splice site sequence"
gaggcgggua

SEQ ID NO: 3249 - RNA, 10 nt, Unknown
  source: /note="Description of Unknown: Exemplary gene or splice site sequence"
cgaguacgau

SEQ ID NO: 3250 - RNA, 10 nt, Unknown
  source: /note="Description of Unknown: Exemplary gene or splice site sequence"
aaaguauggg

SEQ ID NO: 3251 - RNA, 10 nt, Unknown
  source: /note="Description of Unknown: Exemplary gene or splice site sequence"
uaggcugguc

SEQ ID NO: 3252 - RNA, 10 nt, Unknown
  source: /note="Description of Unknown: Exemplary gene or splice site sequence"
uugguaaaac

SEQ ID NO: 3253 - RNA, 10 nt, Unknown
  source: /note="Description of Unknown: Exemplary gene or splice site sequence"
uggguuaugu

SEQ ID NO: 3254 - RNA, 10 nt, Unknown
  source: /note="Description of Unknown: Exemplary gene or splice site sequence"
gauguaacca

SEQ ID NO: 3255 - RNA, 10 nt, Unknown
  source: /note="Description of Unknown: Exemplary gene or splice site sequence"
aaggugcggg

SEQ ID NO: 3256 - RNA, 10 nt, Unknown
  source: /note="Description of Unknown: Exemplary gene or splice site sequence"
ccgguacgug

SEQ ID NO: 3257 - RNA, 10 nt, Unknown
  source: /note="Description of Unknown: Exemplary gene or splice site sequence"
gaugugagaa

SEQ ID NO: 3258 - RNA, 10 nt, Unknown
  source: /note="Description of Unknown: Exemplary gene or splice site sequence"
guggcgguga

SEQ ID NO: 3259 - RNA, 10 nt, Unknown
  source: /note="Description of Unknown: Exemplary gene or splice site sequence"
cagguauuag

SEQ ID NO: 3260 - RNA, 10 nt, Unknown
  source: /note="Description of Unknown: Exemplary gene or splice site sequence"
gagguuggga

SEQ ID NO: 3261 - RNA, 10 nt, Unknown
  source: /note="Description of Unknown: Exemplary gene or splice site sequence"
aaggcuagua

SEQ ID NO: 3262 - RNA, 10 nt, Unknown
  source: /note="Description of Unknown: Exemplary gene or splice site sequence"
caggcaggga

SEQ ID NO: 3263 - RNA, 10 nt, Unknown
  source: /note="Description of Unknown: Exemplary gene or splice site sequence"
aauguuaguu

SEQ ID NO: 3264 - RNA, 10 nt, Unknown
  source: /note="Description of Unknown: Exemplary gene or splice site sequence"
gagguaaagg

SEQ ID NO: 3265 - RNA, 10 nt, Unknown
  source: /note="Description of Unknown: Exemplary gene or splice site sequence"
caggccggcg

SEQ ID NO: 3266 - RNA, 10 nt, Unknown
  source: /note="Description of Unknown: Exemplary gene or splice site sequence"
uaaguacuug

SEQ ID NO: 3267 - RNA, 10 nt, Unknown
  source: /note="Description of Unknown: Exemplary gene or splice site sequence"
ucgguagggg

SEQ ID NO: 3268 - RNA, 10 nt, Unknown
  source: /note="Description of Unknown: Exemplary gene or splice site sequence"
cccgugagau

SEQ ID NO: 3269 - RNA, 10 nt, Unknown
  source: /note="Description of Unknown: Exemplary gene or splice site sequence"
gugguuguuu

SEQ ID NO: 3270 - RNA, 10 nt, Unknown
  source: /note="Description of Unknown: Exemplary gene or splice site sequence"
gagguaagac

SEQ ID NO: 3271 - RNA, 10 nt, Unknown
  source: /note="Description of Unknown: Exemplary gene or splice site sequence"
gauguagguc

SEQ ID NO: 3272 - RNA, 10 nt, Unknown
  source: /note="Description of Unknown: Exemplary gene or splice site sequence"
gagguugggg

SEQ ID NO: 3273 - RNA, 10 nt, Unknown
  source: /note="Description of Unknown: Exemplary gene or splice site sequence"
gaggcgagua

SEQ ID NO: 3274 - RNA, 10 nt, Unknown
  source: /note="Description of Unknown: Exemplary gene or splice site sequence"
ccagcguaau

SEQ ID NO: 3275 - RNA, 10 nt, Unknown
  source: /note="Description of Unknown: Exemplary gene or splice site sequence"
acggugaggu

SEQ ID NO: 3276 - RNA, 10 nt, Unknown
  source: /note="Description of Unknown: Exemplary gene or splice site sequence"
gggguauauu

SEQ ID NO: 3277 - RNA, 10 nt, Unknown
  source: /note="Description of Unknown: Exemplary gene or splice site sequence"
uauguaaauu

SEQ ID NO: 3278 - RNA, 10 nt, Unknown
  source: /note="Description of Unknown: Exemplary gene or splice site sequence"
acgguacuua

SEQ ID NO: 3279 - RNA, 10 nt, Unknown
  source: /note="Description of Unknown: Exemplary gene or splice site sequence"
gaggucagca

SEQ ID NO: 3280 - RNA, 10 nt, Unknown
  source: /note="Description of Unknown: Exemplary gene or splice site sequence"
ggggucagac

SEQ ID NO: 3281 - RNA, 10 nt, Unknown
  source: /note="Description of Unknown: Exemplary gene or splice site sequence"
aaugugugag

SEQ ID NO: 3282 - RNA, 10 nt, Unknown
  source: /note="Description of Unknown: Exemplary gene or splice site sequence"
uccgucagua

SEQ ID NO: 3283 - RNA, 10 nt, Unknown
  source: /note="Description of Unknown: Exemplary gene or splice site sequence"
ccaguuagug

SEQ ID NO: 3284 - RNA, 10 nt, Unknown
  source: /note="Description of Unknown: Exemplary gene or splice site sequence"
agggugcaug

SEQ ID NO: 3285 - RNA, 10 nt, Unknown
  source: /note="Description of Unknown: Exemplary gene or splice site sequence"
gggguaggau

SEQ ID NO: 3286 - RNA, 10 nt, Unknown
  source: /note="Description of Unknown: Exemplary gene or splice site sequence"
gagguguucg

SEQ ID NO: 3287 - RNA, 10 nt, Unknown
  source: /note="Description of Unknown: Exemplary gene or splice site sequence"
uuggcaagaa

SEQ ID NO: 3288 - RNA, 10 nt, Unknown
  source: /note="Description of Unknown: Exemplary gene or splice site sequence"
uccguaagua

SEQ ID NO: 3289 - RNA, 10 nt, Unknown
  source: /note="Description of Unknown: Exemplary gene or splice site sequence"
cagguguaag

SEQ ID NO: 3290 - RNA, 10 nt, Unknown
  source: /note="Description of Unknown: Exemplary gene or splice site sequence"
gagguguuuu

SEQ ID NO: 3291 - RNA, 10 nt, Unknown
  source: /note="Description of Unknown: Exemplary gene or splice site sequence"
guagugagcu

SEQ ID NO: 3292 - RNA, 10 nt, Unknown
  source: /note="Description of Unknown: Exemplary gene or splice site sequence"
caggugaaaa

SEQ ID NO: 3293 - RNA, 10 nt, Unknown
  source: /note="Description of Unknown: Exemplary gene or splice site sequence"
aggguacagg

SEQ ID NO: 3294 - RNA, 10 nt, Unknown
  source: /note="Description of Unknown: Exemplary gene or splice site sequence"
aagguaacgc

SEQ ID NO: 3295 - RNA, 10 nt, Unknown
  source: /note="Description of Unknown: Exemplary gene or splice site sequence"
aagguauacc

SEQ ID NO: 3296 - RNA, 10 nt, Unknown
  source: /note="Description of Unknown: Exemplary gene or splice site sequence"
ccugugagau

SEQ ID NO: 3297 - RNA, 10 nt, Unknown
  source: /note="Description of Unknown: Exemplary gene or splice site sequence"
gggguacgug

SEQ ID NO: 3298 - RNA, 10 nt, Unknown
  source: /note="Description of Unknown: Exemplary gene or splice site sequence"
gaaguaggag

SEQ ID NO: 3299 - RNA, 10 nt, Unknown
  source: /note="Description of Unknown: Exemplary gene or splice site sequence"
ucgguaaggg

SEQ ID NO: 3300 - RNA, 10 nt, Unknown
  source: /note="Description of Unknown: Exemplary gene or splice site sequence"
ccgguaagcg

SEQ ID NO: 3301 - RNA, 10 nt, Unknown
  source: /note="Description of Unknown: Exemplary gene or splice site sequence"
ccaguuuuug

SEQ ID NO: 3302 - RNA, 10 nt, Unknown
  source: /note="Description of Unknown: Exemplary gene or splice site sequence"
aaggugcugu

SEQ ID NO: 3303 - RNA, 10 nt, Unknown
  source: /note="Description of Unknown: Exemplary gene or splice site sequence"
aaaguacacc

SEQ ID NO: 3304 - RNA, 10 nt, Unknown
  source: /note="Description of Unknown: Exemplary gene or splice site sequence"
gaaguacgug

SEQ ID NO: 3305 - RNA, 10 nt, Unknown
  source: /note="Description of Unknown: Exemplary gene or splice site sequence"
uguguagggg

SEQ ID NO: 3306 - RNA, 10 nt, Unknown
  source: /note="Description of Unknown: Exemplary gene or splice site sequence"
uuggugaggc

SEQ ID NO: 3307 - RNA, 10 nt, Unknown
  source: /note="Description of Unknown: Exemplary gene or splice site sequence"
cagguccucc

SEQ ID NO: 3308 - RNA, 10 nt, Unknown
  source: /note="Description of Unknown: Exemplary gene or splice site sequence"
auggucugua

SEQ ID NO: 3309 - RNA, 10 nt, Unknown
  source: /note="Description of Unknown: Exemplary gene or splice site sequence"
caugcaggug

SEQ ID NO: 3310 - RNA, 10 nt, Unknown
  source: /note="Description of Unknown: Exemplary gene or splice site sequence"
cugguacacc

SEQ ID NO: 3311 - RNA, 10 nt, Unknown
  source: /note="Description of Unknown: Exemplary gene or splice site sequence"
cagguccuua

SEQ ID NO: 3312 - RNA, 10 nt, Unknown
  source: /note="Description of Unknown: Exemplary gene or splice site sequence"
auggcagccu

SEQ ID NO: 3313 - RNA, 10 nt, Unknown
  source: /note="Description of Unknown: Exemplary gene or splice site sequence"
aacgugaggc

SEQ ID NO: 3314 - RNA, 10 nt, Unknown
  source: /note="Description of Unknown: Exemplary gene or splice site sequence"
acgguccagg

SEQ ID NO: 3315 - RNA, 10 nt, Unknown
  source: /note="Description of Unknown: Exemplary gene or splice site sequence"
ucuguacaua

SEQ ID NO: 3316 - RNA, 10 nt, Unknown
  source: /note="Description of Unknown: Exemplary gene or splice site sequence"
gaggugauua

SEQ ID NO: 3317 - RNA, 10 nt, Unknown
  source: /note="Description of Unknown: Exemplary gene or splice site sequence"
acgguaaaua

SEQ ID NO: 3318 - RNA, 10 nt, Unknown
  source: /note="Description of Unknown: Exemplary gene or splice site sequence"
augguaacug

SEQ ID NO: 3319 - RNA, 10 nt, Unknown
  source: /note="Description of Unknown: Exemplary gene or splice site sequence"
caggcgcguu

SEQ ID NO: 3320 - RNA, 10 nt, Unknown
  source: /note="Description of Unknown: Exemplary gene or splice site sequence"
aagguuuguu

SEQ ID NO: 3321 - RNA, 10 nt, Unknown
  source: /note="Description of Unknown: Exemplary gene or splice site sequence"
cagguuagga

SEQ ID NO: 3322 - RNA, 10 nt, Unknown
  source: /note="Description of Unknown: Exemplary gene or splice site sequence"
auggugacug

SEQ ID NO: 3323 - RNA, 10 nt, Unknown
  source: /note="Description of Unknown: Exemplary gene or splice site sequence"
uugguauccc

SEQ ID NO: 3324 - RNA, 10 nt, Unknown
  source: /note="Description of Unknown: Exemplary gene or splice site sequence"
cuuguaggac

SEQ ID NO: 3325 - RNA, 10 nt, Unknown
  source: /note="Description of Unknown: Exemplary gene or splice site sequence"
gggguauggc

SEQ ID NO: 3326 - RNA, 10 nt, Unknown
  source: /note="Description of Unknown: Exemplary gene or splice site sequence"
gggguaggac

SEQ ID NO: 3327 - RNA, 10 nt, Unknown
  source: /note="Description of Unknown: Exemplary gene or splice site sequence"
aucguaagcu

SEQ ID NO: 3328 - RNA, 10 nt, Unknown
  source: /note="Description of Unknown: Exemplary gene or splice site sequence"
ggugugagca

SEQ ID NO: 3329 - RNA, 10 nt, Unknown
  source: /note="Description of Unknown: Exemplary gene or splice site sequence"
cugguuggua

SEQ ID NO: 3330 - RNA, 10 nt, Unknown
  source: /note="Description of Unknown: Exemplary gene or splice site sequence"
gggguuaggg

SEQ ID NO: 3331 - RNA, 10 nt, Unknown
  source: /note="Description of Unknown: Exemplary gene or splice site sequence"
ugaguaagaa

SEQ ID NO: 3332 - RNA, 10 nt, Unknown
  source: /note="Description of Unknown: Exemplary gene or splice site sequence"
caggcucgug

SEQ ID NO: 3333 - RNA, 10 nt, Unknown
  source: /note="Description of Unknown: Exemplary gene or splice site sequence"
uagguagagu

SEQ ID NO: 3334 - RNA, 10 nt, Unknown
  source: /note="Description of Unknown: Exemplary gene or splice site sequence"
uaggugcccu

SEQ ID NO: 3335 - RNA, 10 nt, Unknown
  source: /note="Description of Unknown: Exemplary gene or splice site sequence"
accgugugua

SEQ ID NO: 3336 - RNA, 10 nt, Unknown
  source: /note="Description of Unknown: Exemplary gene or splice site sequence"
uauguaguau

SEQ ID NO: 3337 - RNA, 10 nt, Unknown
  source: /note="Description of Unknown: Exemplary gene or splice site sequence"
uggguaauag

SEQ ID NO: 3338 - RNA, 10 nt, Unknown
  source: /note="Description of Unknown: Exemplary gene or splice site sequence"
caggucugaa

SEQ ID NO: 3339 - RNA, 10 nt, Unknown
  source: /note="Description of Unknown: Exemplary gene or splice site sequence"
aaaguauaaa

SEQ ID NO: 3340 - RNA, 10 nt, Unknown
  source: /note="Description of Unknown: Exemplary gene or splice site sequence"
guggugaguc

SEQ ID NO: 3341 - RNA, 10 nt, Unknown
  source: /note="Description of Unknown: Exemplary gene or splice site sequence"
agugugauua

SEQ ID NO: 3342 - RNA, 10 nt, Unknown
  source: /note="Description of Unknown: Exemplary gene or splice site sequence"
gaaguuguag

SEQ ID NO: 3343 - RNA, 10 nt, Unknown
  source: /note="Description of Unknown: Exemplary gene or splice site sequence"
gguguuaaua

SEQ ID NO: 3344 - RNA, 10 nt, Unknown
  source: /note="Description of Unknown: Exemplary gene or splice site sequence"
caaguacucg

SEQ ID NO: 3345 - RNA, 10 nt, Unknown
  source: /note="Description of Unknown: Exemplary gene or splice site sequence"
acggugaggg

SEQ ID NO: 3346 - RNA, 10 nt, Unknown
  source: /note="Description of Unknown: Exemplary gene or splice site sequence"
ugagcaggca

SEQ ID NO: 3347 - RNA, 10 nt, Unknown
  source: /note="Description of Unknown: Exemplary gene or splice site sequence"
ggggugaccg

SEQ ID NO: 3348 - RNA, 10 nt, Unknown
  source: /note="Description of Unknown: Exemplary gene or splice site sequence"
cggguuugug

SEQ ID NO: 3349 - RNA, 10 nt, Unknown
  source: /note="Description of Unknown: Exemplary gene or splice site sequence"
gugguaugga

SEQ ID NO: 3350 - RNA, 10 nt, Unknown
  source: /note="Description of Unknown: Exemplary gene or splice site sequence"
aaggcgggaa

SEQ ID NO: 3351 - RNA, 10 nt, Unknown
  source: /note="Description of Unknown: Exemplary gene or splice site sequence"
aggguaaaac

SEQ ID NO: 3352 - RNA, 10 nt, Unknown
  source: /note="Description of Unknown: Exemplary gene or splice site sequence"
aggguauguu

SEQ ID NO: 3353 - RNA, 10 nt, Unknown
  source: /note="Description of Unknown: Exemplary gene or splice site sequence"
caggcaugua

SEQ ID NO: 3354 - RNA, 10 nt, Unknown
  source: /note="Description of Unknown: Exemplary gene or splice site sequence"
aaggucaugc

SEQ ID NO: 3355 - RNA, 10 nt, Unknown
  source: /note="Description of Unknown: Exemplary gene or splice site sequence"
gauguacguu

SEQ ID NO: 3356 - RNA, 10 nt, Unknown
  source: /note="Description of Unknown: Exemplary gene or splice site sequence"
acaguacgug

SEQ ID NO: 3357 - RNA, 10 nt, Unknown
  source: /note="Description of Unknown: Exemplary gene or splice site sequence"
acgguaccca

SEQ ID NO: 3358 - RNA, 10 nt, Unknown
  source: /note="Description of Unknown: Exemplary gene or splice site sequence"
cagguagugc

SEQ ID NO: 3359 - RNA, 10 nt, Unknown
  source: /note="Description of Unknown: Exemplary gene or splice site sequence"
acaguaagag

SEQ ID NO: 3360 - RNA, 10 nt, Unknown
  source: /note="Description of Unknown: Exemplary gene or splice site sequence"
ggugcacacc

SEQ ID NO: 3361 - RNA, 10 nt, Unknown
  source: /note="Description of Unknown: Exemplary gene or splice site sequence"
gagguguaac

SEQ ID NO: 3362 - RNA, 10 nt, Unknown
  source: /note="Description of Unknown: Exemplary gene or splice site sequence"
uagguacuua

SEQ ID NO: 3363 - RNA, 10 nt, Unknown
  source: /note="Description of Unknown: Exemplary gene or splice site sequence"
gcgguacugc

SEQ ID NO: 3364 - RNA, 10 nt, Unknown
  source: /note="Description of Unknown: Exemplary gene or splice site sequence"
cagguaggau

SEQ ID NO: 3365 - RNA, 10 nt, Unknown
  source: /note="Description of Unknown: Exemplary gene or splice site sequence"
caggucuggc

SEQ ID NO: 3366 - RNA, 10 nt, Unknown
  source: /note="Description of Unknown: Exemplary gene or splice site sequence"
gugguuuuaa

SEQ ID NO: 3367 - RNA, 10 nt, Unknown
  source: /note="Description of Unknown: Exemplary gene or splice site sequence"
cgagugagcc

SEQ ID NO: 3368 - RNA, 10 nt, Unknown
  source: /note="Description of Unknown: Exemplary gene or splice site sequence"
aguguuguca

SEQ ID NO: 3369 - RNA, 10 nt, Unknown
  source: /note="Description of Unknown: Exemplary gene or splice site sequence"
uaaguauguu

SEQ ID NO: 3370 - RNA, 10 nt, Unknown
  source: /note="Description of Unknown: Exemplary gene or splice site sequence"
aagguugagc

SEQ ID NO: 3371 - RNA, 10 nt, Unknown
  source: /note="Description of Unknown: Exemplary gene or splice site sequence"
gguguaagua

SEQ ID NO: 3372 - RNA, 10 nt, Unknown
  source: /note="Description of Unknown: Exemplary gene or splice site sequence"
cagguauaau

SEQ ID NO: 3373 - RNA, 10 nt, Unknown
  source: /note="Description of Unknown: Exemplary gene or splice site sequence"
augguaccaa

SEQ ID NO: 3374 - RNA, 10 nt, Unknown
  source: /note="Description of Unknown: Exemplary gene or splice site sequence"
ugagucagaa

SEQ ID NO: 3375 - RNA, 10 nt, Unknown
  source: /note="Description of Unknown: Exemplary gene or splice site sequence"
aaggcaauua

SEQ ID NO: 3376 - RNA, 10 nt, Unknown
  source: /note="Description of Unknown: Exemplary gene or splice site sequence"
uugguaagau

SEQ ID NO: 3377 - RNA, 10 nt, Unknown
  source: /note="Description of Unknown: Exemplary gene or splice site sequence"
agaguuagag

SEQ ID NO: 3378 - RNA, 10 nt, Unknown
  source: /note="Description of Unknown: Exemplary gene or splice site sequence"
gagguauuac

SEQ ID NO: 3379 - RNA, 10 nt, Unknown
  source: /note="Description of Unknown: Exemplary gene or splice site sequence"
acgguacaga

SEQ ID NO: 3380 - RNA, 10 nt, Unknown
  source: /note="Description of Unknown: Exemplary gene or splice site sequence"
aguguaggcu

SEQ ID NO: 3381 - RNA, 10 nt, Unknown
  source: /note="Description of Unknown: Exemplary gene or splice site sequence"
aaaguaagcg

SEQ ID NO: 3382 - RNA, 10 nt, Unknown
  source: /note="Description of Unknown: Exemplary gene or splice site sequence"
ccuguaagcc

SEQ ID NO: 3383 - RNA, 10 nt, Unknown
  source: /note="Description of Unknown: Exemplary gene or splice site sequence"
agggugauuu

SEQ ID NO: 3384 - RNA, 10 nt, Unknown
  source: /note="Description of Unknown: Exemplary gene or splice site sequence"
uguguaugaa

SEQ ID NO: 3385 - RNA, 10 nt, Unknown
  source: /note="Description of Unknown: Exemplary gene or splice site sequence"
cugguacaca

SEQ ID NO: 3386 - RNA, 10 nt, Unknown
  source: /note="Description of Unknown: Exemplary gene or splice site sequence"
aggguagaga

SEQ ID NO: 3387 - RNA, 10 nt, Unknown
  source: /note="Description of Unknown: Exemplary gene or splice site sequence"
agaguaugua

SEQ ID NO: 3388 - RNA, 10 nt, Unknown
  source: /note="Description of Unknown: Exemplary gene or splice site sequence"
uuggucagca

SEQ ID NO: 3389 - RNA, 10 nt, Unknown
  source: /note="Description of Unknown: Exemplary gene or splice site sequence"
agggugcggg

SEQ ID NO: 3390 - RNA, 10 nt, Unknown
  source: /note="Description of Unknown: Exemplary gene or splice site sequence"
aaagugauga

SEQ ID NO: 3391 - RNA, 10 nt, Unknown
  source: /note="Description of Unknown: Exemplary gene or splice site sequence"
ugcgugagua

SEQ ID NO: 3392 - RNA, 10 nt, Unknown
  source: /note="Description of Unknown: Exemplary gene or splice site sequence"
aagguacaca

SEQ ID NO: 3393 - RNA, 10 nt, Unknown
  source: /note="Description of Unknown: Exemplary gene or splice site sequence"
gcggugagau

SEQ ID NO: 3394 - RNA, 10 nt, Unknown
  source: /note="Description of Unknown: Exemplary gene or splice site sequence"
ccuguagguu

SEQ ID NO: 3395 - RNA, 10 nt, Unknown
  source: /note="Description of Unknown: Exemplary gene or splice site sequence"
aaggugauuc

SEQ ID NO: 3396 - RNA, 10 nt, Unknown
  source: /note="Description of Unknown: Exemplary gene or splice site sequence"
guuguaagug

SEQ ID NO: 3397 - RNA, 10 nt, Unknown
  source: /note="Description of Unknown: Exemplary gene or splice site sequence"
auaguaggga

SEQ ID NO: 3398 - RNA, 10 nt, Unknown
  source: /note="Description of Unknown: Exemplary gene or splice site sequence"
gggguucgcu

SEQ ID NO: 3399 - RNA, 10 nt, Unknown
  source: /note="Description of Unknown: Exemplary gene or splice site sequence"
ccggucagag

SEQ ID NO: 3400 - RNA, 10 nt, Unknown
  source: /note="Description of Unknown: Exemplary gene or splice site sequence"
guaguaugag

SEQ ID NO: 3401 - RNA, 10 nt, Unknown
  source: /note="Description of Unknown: Exemplary gene or splice site sequence"
cguguaagau

SEQ ID NO: 3402 - RNA, 10 nt, Unknown
  source: /note="Description of Unknown: Exemplary gene or splice site sequence"
ugaguaggca

SEQ ID NO: 3403 - RNA, 10 nt, Unknown
  source: /note="Description of Unknown: Exemplary gene or splice site sequence"
ucaguaugua

SEQ ID NO: 3404 - RNA, 10 nt, Unknown
  source: /note="Description of Unknown: Exemplary gene or splice site sequence"
agaguauuuu

SEQ ID NO: 3405 - RNA, 10 nt, Unknown
  source: /note="Description of Unknown: Exemplary gene or splice site sequence"
aagguuguag

SEQ ID NO: 3406 - RNA, 10 nt, Unknown
  source: /note="Description of Unknown: Exemplary gene or splice site sequence"
ucggugcgga

SEQ ID NO: 3407 - RNA, 10 nt, Unknown
  source: /note="Description of Unknown: Exemplary gene or splice site sequence"
gaaguuagau

SEQ ID NO: 3408 - RNA, 10 nt, Unknown
  source: /note="Description of Unknown: Exemplary gene or splice site sequence"
gcugugagac

SEQ ID NO: 3409 - RNA, 10 nt, Unknown
  source: /note="Description of Unknown: Exemplary gene or splice site sequence"
caggcaggua

SEQ ID NO: 3410 - RNA, 10 nt, Unknown
  source: /note="Description of Unknown: Exemplary gene or splice site sequence"
uaaguuaaga

SEQ ID NO: 3411 - RNA, 10 nt, Unknown
  source: /note="Description of Unknown: Exemplary gene or splice site sequence"
gaggcaggca

SEQ ID NO: 3412 - RNA, 10 nt, Unknown
  source: /note="Description of Unknown: Exemplary gene or splice site sequence"
aaggugccua

SEQ ID NO: 3413 - RNA, 10 nt, Unknown
  source: /note="Description of Unknown: Exemplary gene or splice site sequence"
cgggugugag

SEQ ID NO: 3414 - RNA, 10 nt, Unknown
  source: /note="Description of Unknown: Exemplary gene or splice site sequence"
ggggugugag

SEQ ID NO: 3415 - RNA, 10 nt, Unknown
  source: /note="Description of Unknown: Exemplary gene or splice site sequence"
uccguggguc

SEQ ID NO: 3416 - RNA, 10 nt, Unknown
  source: /note="Description of Unknown: Exemplary gene or splice site sequence"
acgguaaauc

SEQ ID NO: 3417 - RNA, 10 nt, Unknown
  source: /note="Description of Unknown: Exemplary gene or splice site sequence"
ucaguaggua

SEQ ID NO: 3418 - RNA, 10 nt, Unknown
  source: /note="Description of Unknown: Exemplary gene or splice site sequence"
caggcggugg

SEQ ID NO: 3419 - RNA, 10 nt, Unknown
  source: /note="Description of Unknown: Exemplary gene or splice site sequence"
cgaguaagcu

SEQ ID NO: 3420 - RNA, 10 nt, Unknown
  source: /note="Description of Unknown: Exemplary gene or splice site sequence"
cccgugagca

SEQ ID NO: 3421 - RNA, 10 nt, Unknown
  source: /note="Description of Unknown: Exemplary gene or splice site sequence"
aaaguaauga

SEQ ID NO: 3422 - RNA, 10 nt, Unknown
  source: /note="Description of Unknown: Exemplary gene or splice site sequence"
cggguaacca

SEQ ID NO: 3423 - RNA, 10 nt, Unknown
  source: /note="Description of Unknown: Exemplary gene or splice site sequence"
caggucgcac

SEQ ID NO: 3424 - RNA, 10 nt, Unknown
  source: /note="Description of Unknown: Exemplary gene or splice site sequence"
gagguaggcc

SEQ ID NO: 3425 - RNA, 10 nt, Unknown
  source: /note="Description of Unknown: Exemplary gene or splice site sequence"
uagguaggca

SEQ ID NO: 3426 - RNA, 10 nt, Unknown
  source: /note="Description of Unknown: Exemplary gene or splice site sequence"
gcggugcgug

SEQ ID NO: 3427 - RNA, 10 nt, Unknown
  source: /note="Description of Unknown: Exemplary gene or splice site sequence"
gaggucacac

SEQ ID NO: 3428 - RNA, 10 nt, Unknown
  source: /note="Description of Unknown: Exemplary gene or splice site sequence"
cagguaggcc

SEQ ID NO: 3429 - RNA, 10 nt, Unknown
  source: /note="Description of Unknown: Exemplary gene or splice site sequence"
caagugcuga

SEQ ID NO: 3430 - RNA, 10 nt, Unknown
  source: /note="Description of Unknown: Exemplary gene or splice site sequence"
gucgucuuca

SEQ ID NO: 3431 - RNA, 10 nt, Unknown
  source: /note="Description of Unknown: Exemplary gene or splice site sequence"
guaguaagga

SEQ ID NO: 3432 - RNA, 10 nt, Unknown
  source: /note="Description of Unknown: Exemplary gene or splice site sequence"
caaguuagag

SEQ ID NO: 3433 - RNA, 10 nt, Unknown
  source: /note="Description of Unknown: Exemplary gene or splice site sequence"
acagugaauc

SEQ ID NO: 3434 - RNA, 10 nt, Unknown
  source: /note="Description of Unknown: Exemplary gene or splice site sequence"
aagguaguau

SEQ ID NO: 3435 - RNA, 10 nt, Unknown
  source: /note="Description of Unknown: Exemplary gene or splice site sequence"
acugucaguc

SEQ ID NO: 3436 - RNA, 10 nt, Unknown
  source: /note="Description of Unknown: Exemplary gene or splice site sequence"
ucugcagccu

SEQ ID NO: 3437 - RNA, 10 nt, Unknown
  source: /note="Description of Unknown: Exemplary gene or splice site sequence"
cgaguaagug

SEQ ID NO: 3438 - RNA, 10 nt, Unknown
  source: /note="Description of Unknown: Exemplary gene or splice site sequence"
agaguaauua

SEQ ID NO: 3439 - RNA, 10 nt, Unknown
  source: /note="Description of Unknown: Exemplary gene or splice site sequence"
ccggugagcg

SEQ ID NO: 3440 - RNA, 10 nt, Unknown
  source: /note="Description of Unknown: Exemplary gene or splice site sequence"
aagguaaccu

SEQ ID NO: 3441 - RNA, 10 nt, Unknown
  source: /note="Description of Unknown: Exemplary gene or splice site sequence"
aagguugugg

SEQ ID NO: 3442 - RNA, 10 nt, Unknown
  source: /note="Description of Unknown: Exemplary gene or splice site sequence"
aaggcauggg

SEQ ID NO: 3443 - RNA, 10 nt, Unknown
  source: /note="Description of Unknown: Exemplary gene or splice site sequence"
acgguaaggu

SEQ ID NO: 3444 - RNA, 10 nt, Unknown
  source: /note="Description of Unknown: Exemplary gene or splice site sequence"
ggggugagca

SEQ ID NO: 3445 - RNA, 10 nt, Unknown
  source: /note="Description of Unknown: Exemplary gene or splice site sequence"
gagguugcuu

SEQ ID NO: 3446 - RNA, 10 nt, Unknown
  source: /note="Description of Unknown: Exemplary gene or splice site sequence"
aagguaucgc

SEQ ID NO: 3447 - RNA, 10 nt, Unknown
  source: /note="Description of Unknown: Exemplary gene or splice site sequence"
ccgguaaagg

SEQ ID NO: 3448 - RNA, 10 nt, Unknown
  source: /note="Description of Unknown: Exemplary gene or splice site sequence"
aaaguuaaug

SEQ ID NO: 3449 - RNA, 10 nt, Unknown
  source: /note="Description of Unknown: Exemplary gene or splice site sequence"
accguaauua

SEQ ID NO: 3450 - RNA, 10 nt, Unknown
  source: /note="Description of Unknown: Exemplary gene or splice site sequence"
ccgguaacgc

SEQ ID NO: 3451 - RNA, 10 nt, Unknown
  source: /note="Description of Unknown: Exemplary gene or splice site sequence"
augguaauua

SEQ ID NO: 3452 - RNA, 10 nt, Unknown
  source: /note="Description of Unknown: Exemplary gene or splice site sequence"
aaggugacuc

SEQ ID NO: 3453 - RNA, 10 nt, Unknown
  source: /note="Description of Unknown: Exemplary gene or splice site sequence"
aggguaaaaa

SEQ ID NO: 3454 - RNA, 10 nt, Unknown
  source: /note="Description of Unknown: Exemplary gene or splice site sequence"
gaggugugac

SEQ ID NO: 3455 - RNA, 10 nt, Unknown
  source: /note="Description of Unknown: Exemplary gene or splice site sequence"
cacguaagcu

SEQ ID NO: 3456 - RNA, 10 nt, Unknown
  source: /note="Description of Unknown: Exemplary gene or splice site sequence"
cagguccccc

SEQ ID NO: 3457 - RNA, 10 nt, Unknown
  source: /note="Description of Unknown: Exemplary gene or splice site sequence"
caggucaggu

SEQ ID NO: 3458 - RNA, 10 nt, Unknown
  source: /note="Description of Unknown: Exemplary gene or splice site sequence"
cggguaaguc

SEQ ID NO: 3459 - RNA, 10 nt, Unknown
  source: /note="Description of Unknown: Exemplary gene or splice site sequence"
acgguauggg

SEQ ID NO: 3460 - RNA, 10 nt, Unknown
  source: /note="Description of Unknown: Exemplary gene or splice site sequence"
caaguaauau

SEQ ID NO: 3461 - RNA, 10 nt, Unknown
  source: /note="Description of Unknown: Exemplary gene or splice site sequence"
cagguugggg

SEQ ID NO: 3462 - RNA, 10 nt, Unknown
  source: /note="Description of Unknown: Exemplary gene or splice site sequence"
ccugugcugg

SEQ ID NO: 3463 - RNA, 10 nt, Unknown
  source: /note="Description of Unknown: Exemplary gene or splice site sequence"
aggguagagg

SEQ ID NO: 3464 - RNA, 10 nt, Unknown
  source: /note="Description of Unknown: Exemplary gene or splice site sequence"
aggguagggc

SEQ ID NO: 3465 - RNA, 10 nt, Unknown
  source: /note="Description of Unknown: Exemplary gene or splice site sequence"
guggugagua

SEQ ID NO: 3466 - RNA, 10 nt, Unknown
  source: /note="Description of Unknown: Exemplary gene or splice site sequence"
aauguauauc

SEQ ID NO: 3467 - RNA, 10 nt, Unknown
  source: /note="Description of Unknown: Exemplary gene or splice site sequence"
agggugaggc

SEQ ID NO: 3468 - RNA, 10 nt, Unknown
  source: /note="Description of Unknown: Exemplary gene or splice site sequence"
ggggugugcu

SEQ ID NO: 3469 - RNA, 10 nt, Unknown
  source: /note="Description of Unknown: Exemplary gene or splice site sequence"
aauguaaccu

SEQ ID NO: 3470 - RNA, 10 nt, Unknown
  source: /note="Description of Unknown: Exemplary gene or splice site sequence"
caggugcacu

SEQ ID NO: 3471 - RNA, 10 nt, Unknown
  source: /note="Description of Unknown: Exemplary gene or splice site sequence"
gagguauccu

SEQ ID NO: 3472 - RNA, 10 nt, Unknown
  source: /note="Description of Unknown: Exemplary gene or splice site sequence"
uguguaagug

SEQ ID NO: 3473 - RNA, 10 nt, Unknown
  source: /note="Description of Unknown: Exemplary gene or splice site sequence"
ccagcaaggc

SEQ ID NO: 3474 - RNA, 10 nt, Unknown
  source: /note="Description of Unknown: Exemplary gene or splice site sequence"
aauguggggu

SEQ ID NO: 3475 - RNA, 10 nt, Unknown
  source: /note="Description of Unknown: Exemplary gene or splice site sequence"
ucggugcgug

SEQ ID NO: 3476 - RNA, 10 nt, Unknown
  source: /note="Description of Unknown: Exemplary gene or splice site sequence"
uugguaaggc

SEQ ID NO: 3477 - RNA, 10 nt, Unknown
  source: /note="Description of Unknown: Exemplary gene or splice site sequence"
gagguaagug

SEQ ID NO: 3478 - RNA, 10 nt, Unknown
  source: /note="Description of Unknown: Exemplary gene or splice site sequence"
uaggucuuuu

SEQ ID NO: 3479 - RNA, 10 nt, Unknown
  source: /note="Description of Unknown: Exemplary gene or splice site sequence"
gaggucugau

SEQ ID NO: 3480 - RNA, 10 nt, Unknown
  source: /note="Description of Unknown: Exemplary gene or splice site sequence"
ccaguuagag

SEQ ID NO: 3481 - RNA, 10 nt, Unknown
  source: /note="Description of Unknown: Exemplary gene or splice site sequence"
ugggugaaaa

SEQ ID NO: 3482 - RNA, 10 nt, Unknown
  source: /note="Description of Unknown: Exemplary gene or splice site sequence"
caggccgguc

SEQ ID NO: 3483 - RNA, 10 nt, Unknown
  source: /note="Description of Unknown: Exemplary gene or splice site sequence"
ccgguaagag

SEQ ID NO: 3484 - RNA, 10 nt, Unknown
  source: /note="Description of Unknown: Exemplary gene or splice site sequence"
cugguaagac

SEQ ID NO: 3485 - RNA, 10 nt, Unknown
  source: /note="Description of Unknown: Exemplary gene or splice site sequence"
cugguuuguu

SEQ ID NO: 3486 - RNA, 10 nt, Unknown
  source: /note="Description of Unknown: Exemplary gene or splice site sequence"
uggguaggua

SEQ ID NO: 3487 - RNA, 10 nt, Unknown
  source: /note="Description of Unknown: Exemplary gene or splice site sequence"
cagguguucg

SEQ ID NO: 3488 - RNA, 10 nt, Unknown
  source: /note="Description of Unknown: Exemplary gene or splice site sequence"
cggguagguc

SEQ ID NO: 3489 - RNA, 10 nt, Unknown
  source: /note="Description of Unknown: Exemplary gene or splice site sequence"
gugguacaua

SEQ ID NO: 3490 - RNA, 10 nt, Unknown
  source: /note="Description of Unknown: Exemplary gene or splice site sequence"
gaugugagua

SEQ ID NO: 3491 - RNA, 10 nt, Unknown
  source: /note="Description of Unknown: Exemplary gene or splice site sequence"
gagguagccg

SEQ ID NO: 3492 - RNA, 10 nt, Unknown
  source: /note="Description of Unknown: Exemplary gene or splice site sequence"
uaggugaucu

SEQ ID NO: 3493 - RNA, 10 nt, Unknown
  source: /note="Description of Unknown: Exemplary gene or splice site sequence"
cuugucaguc

SEQ ID NO: 3494 - RNA, 10 nt, Unknown
  source: /note="Description of Unknown: Exemplary gene or splice site sequence"
gagguaucac

SEQ ID NO: 3495 - RNA, 10 nt, Unknown
  source: /note="Description of Unknown: Exemplary gene or splice site sequence"
gagguaauga

SEQ ID NO: 3496 - RNA, 10 nt, Unknown
  source: /note="Description of Unknown: Exemplary gene or splice site sequence"
aagguaacac

SEQ ID NO: 3497 - RNA, 10 nt, Unknown
  source: /note="Description of Unknown: Exemplary gene or splice site sequence"
aaggcaagua

SEQ ID NO: 3498 - RNA, 10 nt, Unknown
  source: /note="Description of Unknown: Exemplary gene or splice site sequence"
cgcgugagcc

SEQ ID NO: 3499 - RNA, 10 nt, Unknown
  source: /note="Description of Unknown: Exemplary gene or splice site sequence"
agugugcguu

SEQ ID NO: 3500 - RNA, 10 nt, Unknown
  source: /note="Description of Unknown: Exemplary gene or splice site sequence"
ggagcaguug

SEQ ID NO: 3501 - RNA, 10 nt, Unknown
  source: /note="Description of Unknown: Exemplary gene or splice site sequence"
agcguaagau

SEQ ID NO: 3502 - RNA, 10 nt, Unknown
  source: /note="Description of Unknown: Exemplary gene or splice site sequence"
gagguauuca

SEQ ID NO: 3503 - RNA, 10 nt, Unknown
  source: /note="Description of Unknown: Exemplary gene or splice site sequence"
aauguaaagu

SEQ ID NO: 3504 - RNA, 10 nt, Unknown
  source: /note="Description of Unknown: Exemplary gene or splice site sequence"
cagguaacaa

SEQ ID NO: 3505 - RNA, 10 nt, Unknown
  source: /note="Description of Unknown: Exemplary gene or splice site sequence"
ucgguaggug

SEQ ID NO: 3506 - RNA, 10 nt, Unknown
  source: /note="Description of Unknown: Exemplary gene or splice site sequence"
cgggugcagu

SEQ ID NO: 3507 - RNA, 10 nt, Unknown
  source: /note="Description of Unknown: Exemplary gene or splice site sequence"
ggugugugca

SEQ ID NO: 3508 - RNA, 10 nt, Unknown
  source: /note="Description of Unknown: Exemplary gene or splice site sequence"
cacguguaag

SEQ ID NO: 3509 - RNA, 10 nt, Unknown
  source: /note="Description of Unknown: Exemplary gene or splice site sequence"
gugguuggua

SEQ ID NO: 3510 - RNA, 10 nt, Unknown
  source: /note="Description of Unknown: Exemplary gene or splice site sequence"
gcagccuuga

SEQ ID NO: 3511 - RNA, 10 nt, Unknown
  source: /note="Description of Unknown: Exemplary gene or splice site sequence"
cgagugugau

SEQ ID NO: 3512 - RNA, 10 nt, Unknown
  source: /note="Description of Unknown: Exemplary gene or splice site sequence"
cagguauaua

SEQ ID NO: 3513 - RNA, 10 nt, Unknown
  source: /note="Description of Unknown: Exemplary gene or splice site sequence"
cccgugguca

SEQ ID NO: 3514 - RNA, 10 nt, Unknown
  source: /note="Description of Unknown: Exemplary gene or splice site sequence"
aguguauccu

SEQ ID NO: 3515 - RNA, 10 nt, Unknown
  source: /note="Description of Unknown: Exemplary gene or splice site sequence"
ugaguguguc

SEQ ID NO: 3516 - RNA, 10 nt, Unknown
  source: /note="Description of Unknown: Exemplary gene or splice site sequence"
uggguaaucu

SEQ ID NO: 3517 - RNA, 10 nt, Unknown
  source: /note="Description of Unknown: Exemplary gene or splice site sequence"
auggcagguu

SEQ ID NO: 3518 - RNA, 10 nt, Unknown
  source: /note="Description of Unknown: Exemplary gene or splice site sequence"
ucagcagcgu

SEQ ID NO: 3519 - RNA, 10 nt, Unknown
  source: /note="Description of Unknown: Exemplary gene or splice site sequence"
cgggugcgcu

SEQ ID NO: 3520 - RNA, 10 nt, Unknown
  source: /note="Description of Unknown: Exemplary gene or splice site sequence"
agcgugguaa

SEQ ID NO: 3521 - RNA, 10 nt, Unknown
  source: /note="Description of Unknown: Exemplary gene or splice site sequence"
aaugugaaug

SEQ ID NO: 3522 - RNA, 10 nt, Unknown
  source: /note="Description of Unknown: Exemplary gene or splice site sequence"
ucggugagac

SEQ ID NO: 3523 - RNA, 10 nt, Unknown
  source: /note="Description of Unknown: Exemplary gene or splice site sequence"
uagguaaagc

SEQ ID NO: 3524 - RNA, 10 nt, Unknown
  source: /note="Description of Unknown: Exemplary gene or splice site sequence"
cugguaaaag

SEQ ID NO: 3525 - RNA, 10 nt, Unknown
  source: /note="Description of Unknown: Exemplary gene or splice site sequence"
ccggugcgga

SEQ ID NO: 3526 - RNA, 10 nt, Unknown
  source: /note="Description of Unknown: Exemplary gene or splice site sequence"
cagguacuca

SEQ ID NO: 3527 - RNA, 10 nt, Unknown
  source: /note="Description of Unknown: Exemplary gene or splice site sequence"
gaaguugagu

SEQ ID NO: 3528 - RNA, 10 nt, Unknown
  source: /note="Description of Unknown: Exemplary gene or splice site sequence"
uagguaugcu

SEQ ID NO: 3529 - RNA, 10 nt, Unknown
  source: /note="Description of Unknown: Exemplary gene or splice site sequence"
cguguaagcc

SEQ ID NO: 3530 - RNA, 10 nt, Unknown
  source: /note="Description of Unknown: Exemplary gene or splice site sequence"
ucggcaaggc

SEQ ID NO: 3531 - RNA, 10 nt, Unknown
  source: /note="Description of Unknown: Exemplary gene or splice site sequence"
gagguucucg

SEQ ID NO: 3532 - RNA, 10 nt, Unknown
  source: /note="Description of Unknown: Exemplary gene or splice site sequence"
aaggcaugug

SEQ ID NO: 3533 - RNA, 10 nt, Unknown
  source: /note="Description of Unknown: Exemplary gene or splice site sequence"
uaagucauuu

SEQ ID NO: 3534 - RNA, 10 nt, Unknown
  source: /note="Description of Unknown: Exemplary gene or splice site sequence"
aauguaaaga

SEQ ID NO: 3535 - RNA, 10 nt, Unknown
  source: /note="Description of Unknown: Exemplary gene or splice site sequence"
uaggugcuca

SEQ ID NO: 3536 - RNA, 10 nt, Unknown
  source: /note="Description of Unknown: Exemplary gene or splice site sequence"
gagguacuga

SEQ ID NO: 3537 - RNA, 10 nt, Unknown
  source: /note="Description of Unknown: Exemplary gene or splice site sequence"
uggguaaaaa

SEQ ID NO: 3538 - RNA, 10 nt, Unknown
  source: /note="Description of Unknown: Exemplary gene or splice site sequence"
uacgugaguu

SEQ ID NO: 3539 - RNA, 10 nt, Unknown
  source: /note="Description of Unknown: Exemplary gene or splice site sequence"
cgggugagga

SEQ ID NO: 3540 - RNA, 10 nt, Unknown
  source: /note="Description of Unknown: Exemplary gene or splice site sequence"
gguguaagcu

SEQ ID NO: 3541 - RNA, 10 nt, Unknown
  source: /note="Description of Unknown: Exemplary gene or splice site sequence"
ccagcuaagu

SEQ ID NO: 3542 - RNA, 10 nt, Unknown
  source: /note="Description of Unknown: Exemplary gene or splice site sequence"
gagguaccuc

SEQ ID NO: 3543 - RNA, 10 nt, Unknown
  source: /note="Description of Unknown: Exemplary gene or splice site sequence"
gagguuagga

SEQ ID NO: 3544 - RNA, 10 nt, Unknown
  source: /note="Description of Unknown: Exemplary gene or splice site sequence"
ugcgugugua

SEQ ID NO: 3545 - RNA, 10 nt, Unknown
  source: /note="Description of Unknown: Exemplary gene or splice site sequence"
ccaguaacca

SEQ ID NO: 3546 - RNA, 10 nt, Unknown
  source: /note="Description of Unknown: Exemplary gene or splice site sequence"
agggucuguc

SEQ ID NO: 3547 - RNA, 10 nt, Unknown
  source: /note="Description of Unknown: Exemplary gene or splice site sequence"
cagguaaccu

SEQ ID NO: 3548 - RNA, 10 nt, Unknown
  source: /note="Description of Unknown: Exemplary gene or splice site sequence"
uagguucgug

SEQ ID NO: 3549 - RNA, 10 nt, Unknown
  source: /note="Description of Unknown: Exemplary gene or splice site sequence"
aaaguuagua

SEQ ID NO: 3550 - RNA, 10 nt, Unknown
  source: /note="Description of Unknown: Exemplary gene or splice site sequence"
aaggcacagu

SEQ ID NO: 3551 - RNA, 10 nt, Unknown
  source: /note="Description of Unknown: Exemplary gene or splice site sequence"
cuugcauggg

SEQ ID NO: 3552 - RNA, 10 nt, Unknown
  source: /note="Description of Unknown: Exemplary gene or splice site sequence"
gcggugagua

SEQ ID NO: 3553 - RNA, 10 nt, Unknown
  source: /note="Description of Unknown: Exemplary gene or splice site sequence"
gggguaagcg

SEQ ID NO: 3554 - RNA, 10 nt, Unknown
  source: /note="Description of Unknown: Exemplary gene or splice site sequence"
gccguaagaa

SEQ ID NO: 3555 - RNA, 10 nt, Unknown
  source: /note="Description of Unknown: Exemplary gene or splice site sequence"
gaggucggga

SEQ ID NO: 3556 - RNA, 10 nt, Unknown
  source: /note="Description of Unknown: Exemplary gene or splice site sequence"
agugugagac

SEQ ID NO: 3557 - RNA, 10 nt, Unknown
  source: /note="Description of Unknown: Exemplary gene or splice site sequence"
ccgguggguc

SEQ ID NO: 3558 - RNA, 10 nt, Unknown
  source: /note="Description of Unknown: Exemplary gene or splice site sequence"
uggguaacgu

SEQ ID NO: 3559 - RNA, 10 nt, Unknown
  source: /note="Description of Unknown: Exemplary gene or splice site sequence"
uuggugagag

SEQ ID NO: 3560 - RNA, 10 nt, Unknown
  source: /note="Description of Unknown: Exemplary gene or splice site sequence"
uagguacccu

SEQ ID NO: 3561 - RNA, 10 nt, Unknown
  source: /note="Description of Unknown: Exemplary gene or splice site sequence"
ggggugcguc

SEQ ID NO: 3562 - RNA, 10 nt, Unknown
  source: /note="Description of Unknown: Exemplary gene or splice site sequence"
aaggcaggag

SEQ ID NO: 3563 - RNA, 10 nt, Unknown
  source: /note="Description of Unknown: Exemplary gene or splice site sequence"
acgguacauu

SEQ ID NO: 3564 - RNA, 10 nt, Unknown
  source: /note="Description of Unknown: Exemplary gene or splice site sequence"
augguauacu

SEQ ID NO: 3565 - RNA, 10 nt, Unknown
  source: /note="Description of Unknown: Exemplary gene or splice site sequence"
acaguaacga

SEQ ID NO: 3566 - RNA, 10 nt, Unknown
  source: /note="Description of Unknown: Exemplary gene or splice site sequence"
cugguaccca

SEQ ID NO: 3567 - RNA, 10 nt, Unknown
  source: /note="Description of Unknown: Exemplary gene or splice site sequence"
cagguaaccc

SEQ ID NO: 3568 - RNA, 10 nt, Unknown
  source: /note="Description of Unknown: Exemplary gene or splice site sequence"
ggaguaagua

SEQ ID NO: 3569 - RNA, 10 nt, Unknown
  source: /note="Description of Unknown: Exemplary gene or splice site sequence"
acuguauguc

SEQ ID NO: 3570 - RNA, 10 nt, Unknown
  source: /note="Description of Unknown: Exemplary gene or splice site sequence"
cugguaaugu

SEQ ID NO: 3571 - RNA, 10 nt, Unknown
  source: /note="Description of Unknown: Exemplary gene or splice site sequence"
agugucagug

SEQ ID NO: 3572 - RNA, 10 nt, Unknown
  source: /note="Description of Unknown: Exemplary gene or splice site sequence"
ggaguaugug

SEQ ID NO: 3573 - RNA, 10 nt, Unknown
  source: /note="Description of Unknown: Exemplary gene or splice site sequence"
ccuguuguga

SEQ ID NO: 3574 - RNA, 10 nt, Unknown
  source: /note="Description of Unknown: Exemplary gene or splice site sequence"
cagguaagca

SEQ ID NO: 3575 - RNA, 10 nt, Unknown
  source: /note="Description of Unknown: Exemplary gene or splice site sequence"
caggucacag

SEQ ID NO: 3576 - RNA, 10 nt, Unknown
  source: /note="Description of Unknown: Exemplary gene or splice site sequence"
uagguuugcg

SEQ ID NO: 3577 - RNA, 10 nt, Unknown
  source: /note="Description of Unknown: Exemplary gene or splice site sequence"
acgguuguau

SEQ ID NO: 3578 - RNA, 10 nt, Unknown
  source: /note="Description of Unknown: Exemplary gene or splice site sequence"
gggguuaguu

SEQ ID NO: 3579 - RNA, 10 nt, Unknown
  source: /note="Description of Unknown: Exemplary gene or splice site sequence"
acgguaaggc

SEQ ID NO: 3580 - RNA, 10 nt, Unknown
  source: /note="Description of Unknown: Exemplary gene or splice site sequence"
ggggugagag

SEQ ID NO: 3581 - RNA, 10 nt, Unknown
  source: /note="Description of Unknown: Exemplary gene or splice site sequence"
caggcaggcc

SEQ ID NO: 3582 - RNA, 10 nt, Unknown
  source: /note="Description of Unknown: Exemplary gene or splice site sequence"
cacgugcagg

SEQ ID NO: 3583 - RNA, 10 nt, Unknown
  source: /note="Description of Unknown: Exemplary gene or splice site sequence"
gcgguauaau

SEQ ID NO: 3584 - RNA, 10 nt, Unknown
  source: /note="Description of Unknown: Exemplary gene or splice site sequence"
uagguaaagu

SEQ ID NO: 3585 - RNA, 10 nt, Unknown
  source: /note="Description of Unknown: Exemplary gene or splice site sequence"
uagguggauu

SEQ ID NO: 3586 - RNA, 10 nt, Unknown
  source: /note="Description of Unknown: Exemplary gene or splice site sequence"
gaggucugga

SEQ ID NO: 3587 - RNA, 10 nt, Unknown
  source: /note="Description of Unknown: Exemplary gene or splice site sequence"
ucggucaguu

SEQ ID NO: 3588 - RNA, 10 nt, Unknown
  source: /note="Description of Unknown: Exemplary gene or splice site sequence"
uggguaacug

SEQ ID NO: 3589 - RNA, 10 nt, Unknown
  source: /note="Description of Unknown: Exemplary gene or splice site sequence"
aagguuugau

SEQ ID NO: 3590 - RNA, 10 nt, Unknown
  source: /note="Description of Unknown: Exemplary gene or splice site sequence"
ugugcuggug

SEQ ID NO: 3591 - RNA, 10 nt, Unknown
  source: /note="Description of Unknown: Exemplary gene or splice site sequence"
uguguaccuc

SEQ ID NO: 3592 - RNA, 10 nt, Unknown
  source: /note="Description of Unknown: Exemplary gene or splice site sequence"
aucgucagcg

SEQ ID NO: 3593 - RNA, 10 nt, Unknown
  source: /note="Description of Unknown: Exemplary gene or splice site sequence"
caggucuugg

SEQ ID NO: 3594 - RNA, 10 nt, Unknown
  source: /note="Description of Unknown: Exemplary gene or splice site sequence"
gaaguuggua

SEQ ID NO: 3595 - RNA, 10 nt, Unknown
  source: /note="Description of Unknown: Exemplary gene or splice site sequence"
gaaguaaaga

SEQ ID NO: 3596 - RNA, 10 nt, Unknown
  source: /note="Description of Unknown: Exemplary gene or splice site sequence"
aggguaucau

SEQ ID NO: 3597 - RNA, 10 nt, Unknown
  source: /note="Description of Unknown: Exemplary gene or splice site sequence"
uggguuguuu

SEQ ID NO: 3598 - RNA, 10 nt, Unknown
  source: /note="Description of Unknown: Exemplary gene or splice site sequence"
agcgugagau

SEQ ID NO: 3599 - RNA, 10 nt, Unknown
  source: /note="Description of Unknown: Exemplary gene or splice site sequence"
aggguagaug

SEQ ID NO: 3600 - RNA, 10 nt, Unknown
  source: /note="Description of Unknown: Exemplary gene or splice site sequence"
aucgcgugag

SEQ ID NO: 3601 - RNA, 10 nt, Unknown
  source: /note="Description of Unknown: Exemplary gene or splice site sequence"
aggguaagcc

SEQ ID NO: 3602 - RNA, 10 nt, Unknown
  source: /note="Description of Unknown: Exemplary gene or splice site sequence"
aggguagcag

SEQ ID NO: 3603 - RNA, 10 nt, Unknown
  source: /note="Description of Unknown: Exemplary gene or splice site sequence"
uucguuuccg

SEQ ID NO: 3604 - RNA, 10 nt, Unknown
  source: /note="Description of Unknown: Exemplary gene or splice site sequence"
cagguauggc

SEQ ID NO: 3605 - RNA, 10 nt, Unknown
  source: /note="Description of Unknown: Exemplary gene or splice site sequence"
aagguagaga

SEQ ID NO: 3606 - RNA, 10 nt, Unknown
  source: /note="Description of Unknown: Exemplary gene or splice site sequence"
acgguaauaa

SEQ ID NO: 3607 - RNA, 10 nt, Unknown
  source: /note="Description of Unknown: Exemplary gene or splice site sequence"
cugguacggu

SEQ ID NO: 3608 - RNA, 10 nt, Unknown
  source: /note="Description of Unknown: Exemplary gene or splice site sequence"
gaggucacag

SEQ ID NO: 3609 - RNA, 10 nt, Unknown
  source: /note="Description of Unknown: Exemplary gene or splice site sequence"
cugguacgcc

SEQ ID NO: 3610 - RNA, 10 nt, Unknown
  source: /note="Description of Unknown: Exemplary gene or splice site sequence"
ccgguaaccg

SEQ ID NO: 3611 - RNA, 10 nt, Unknown
  source: /note="Description of Unknown: Exemplary gene or splice site sequence"
cuuguaaguc

SEQ ID NO: 3612 - RNA, 10 nt, Unknown
  source: /note="Description of Unknown: Exemplary gene or splice site sequence"
accguaugua

SEQ ID NO: 3613 - RNA, 10 nt, Unknown
  source: /note="Description of Unknown: Exemplary gene or splice site sequence"
cggguacuuu

SEQ ID NO: 3614 - RNA, 10 nt, Unknown
  source: /note="Description of Unknown: Exemplary gene or splice site sequence"
aagguaugcg

SEQ ID NO: 3615 - RNA, 10 nt, Unknown
  source: /note="Description of Unknown: Exemplary gene or splice site sequence"
ccuguaggcu

SEQ ID NO: 3616 - RNA, 10 nt, Unknown
  source: /note="Description of Unknown: Exemplary gene or splice site sequence"
acaguagaaa

SEQ ID NO: 3617 - RNA, 10 nt, Unknown
  source: /note="Description of Unknown: Exemplary gene or splice site sequence"
ccgguuagua

SEQ ID NO: 3618 - RNA, 10 nt, Unknown
  source: /note="Description of Unknown: Exemplary gene or splice site sequence"
cggguaggcg

SEQ ID NO: 3619 - RNA, 10 nt, Unknown
  source: /note="Description of Unknown: Exemplary gene or splice site sequence"
gaggugaguc

SEQ ID NO: 3620 - RNA, 10 nt, Unknown
  source: /note="Description of Unknown: Exemplary gene or splice site sequence"
cugguagccu

SEQ ID NO: 3621 - RNA, 10 nt, Unknown
  source: /note="Description of Unknown: Exemplary gene or splice site sequence"
gaaguaacuu

SEQ ID NO: 3622 - RNA, 10 nt, Unknown
  source: /note="Description of Unknown: Exemplary gene or splice site sequence"
gaaguaagau

SEQ ID NO: 3623 - RNA, 10 nt, Unknown
  source: /note="Description of Unknown: Exemplary gene or splice site sequence"
guaguucuau

SEQ ID NO: 3624 - RNA, 10 nt, Unknown
  source: /note="Description of Unknown: Exemplary gene or splice site sequence"
gagguacaug

SEQ ID NO: 3625 - RNA, 10 nt, Unknown
  source: /note="Description of Unknown: Exemplary gene or splice site sequence"
uggguaaggc

SEQ ID NO: 3626 - RNA, 10 nt, Unknown
  source: /note="Description of Unknown: Exemplary gene or splice site sequence"
ccaguuacgc

SEQ ID NO: 3627 - RNA, 10 nt, Unknown
  source: /note="Description of Unknown: Exemplary gene or splice site sequence"
acugugguga

SEQ ID NO: 3628 - RNA, 10 nt, Unknown
  source: /note="Description of Unknown: Exemplary gene or splice site sequence"
auuguaggug

SEQ ID NO: 3629 - RNA, 10 nt, Unknown
  source: /note="Description of Unknown: Exemplary gene or splice site sequence"
accgucagug

SEQ ID NO: 3630 - RNA, 10 nt, Unknown
  source: /note="Description of Unknown: Exemplary gene or splice site sequence"
aaugugaggg

SEQ ID NO: 3631 - RNA, 10 nt, Unknown
  source: /note="Description of Unknown: Exemplary gene or splice site sequence"
uggguguggu

SEQ ID NO: 3632 - RNA, 10 nt, Unknown
  source: /note="Description of Unknown: Exemplary gene or splice site sequence"
uccgugagug

SEQ ID NO: 3633 - RNA, 10 nt, Unknown
  source: /note="Description of Unknown: Exemplary gene or splice site sequence"
caggcaagcu

SEQ ID NO: 3634 - RNA, 10 nt, Unknown
  source: /note="Description of Unknown: Exemplary gene or splice site sequence"
aaaguagcag

SEQ ID NO: 3635 - RNA, 10 nt, Unknown
  source: /note="Description of Unknown: Exemplary gene or splice site sequence"
cuugucagug

SEQ ID NO: 3636 - RNA, 10 nt, Unknown
  source: /note="Description of Unknown: Exemplary gene or splice site sequence"
uaggugcgcu

SEQ ID NO: 3637 - RNA, 10 nt, Unknown
  source: /note="Description of Unknown: Exemplary gene or splice site sequence"
gaggcaaauu

SEQ ID NO: 3638 - RNA, 10 nt, Unknown
  source: /note="Description of Unknown: Exemplary gene or splice site sequence"
aggguaccuc

SEQ ID NO: 3639 - RNA, 10 nt, Unknown
  source: /note="Description of Unknown: Exemplary gene or splice site sequence"
caagugcgua

SEQ ID NO: 3640 - RNA, 10 nt, Unknown
  source: /note="Description of Unknown: Exemplary gene or splice site sequence"
gugguaaaua

SEQ ID NO: 3641 - RNA, 10 nt, Unknown
  source: /note="Description of Unknown: Exemplary gene or splice site sequence"
gauguaagcg

SEQ ID NO: 3642 - RNA, 10 nt, Unknown
  source: /note="Description of Unknown: Exemplary gene or splice site sequence"
ccuguacggc

SEQ ID NO: 3643 - RNA, 10 nt, Unknown
  source: /note="Description of Unknown: Exemplary gene or splice site sequence"
uagguccaua

SEQ ID NO: 3644 - RNA, 10 nt, Unknown
  source: /note="Description of Unknown: Exemplary gene or splice site sequence"
aaaguacuga

SEQ ID NO: 3645 - RNA, 10 nt, Unknown
  source: /note="Description of Unknown: Exemplary gene or splice site sequence"
uugguaagcg

SEQ ID NO: 3646 - RNA, 10 nt, Unknown
  source: /note="Description of Unknown: Exemplary gene or splice site sequence"
caggcaagcg

SEQ ID NO: 3647 - RNA, 10 nt, Unknown
  source: /note="Description of Unknown: Exemplary gene or splice site sequence"
uuugcagguu

SEQ ID NO: 3648 - RNA, 10 nt, Unknown
  source: /note="Description of Unknown: Exemplary gene or splice site sequence"
cagguuuaua

SEQ ID NO: 3649 - RNA, 10 nt, Unknown
  source: /note="Description of Unknown: Exemplary gene or splice site sequence"
guaguaaguu

SEQ ID NO: 3650 - RNA, 10 nt, Unknown
  source: /note="Description of Unknown: Exemplary gene or splice site sequence"
cagguaauac

SEQ ID NO: 3651 - RNA, 10 nt, Unknown
  source: /note="Description of Unknown: Exemplary gene or splice site sequence"
caggcaaggc

SEQ ID NO: 3652 - RNA, 10 nt, Unknown
  source: /note="Description of Unknown: Exemplary gene or splice site sequence"
uuuguccgug

SEQ ID NO: 3653 - RNA, 10 nt, Unknown
  source: /note="Description of Unknown: Exemplary gene or splice site sequence"
accgugagug

SEQ ID NO: 3654 - RNA, 10 nt, Unknown
  source: /note="Description of Unknown: Exemplary gene or splice site sequence"
caaguaagcu

SEQ ID NO: 3655 - RNA, 10 nt, Unknown
  source: /note="Description of Unknown: Exemplary gene or splice site sequence"
cagguaaagg

SEQ ID NO: 3656 - RNA, 10 nt, Unknown
  source: /note="Description of Unknown: Exemplary gene or splice site sequence"
aaggcaagcg

SEQ ID NO: 3657 - RNA, 10 nt, Unknown
  source: /note="Description of Unknown: Exemplary gene or splice site sequence"
aguguacgug

SEQ ID NO: 3658 - RNA, 10 nt, Unknown
  source: /note="Description of Unknown: Exemplary gene or splice site sequence"
agggugcgua

SEQ ID NO: 3659 - RNA, 10 nt, Unknown
  source: /note="Description of Unknown: Exemplary gene or splice site sequence"
cgaguuauga

SEQ ID NO: 3660 - RNA, 10 nt, Unknown
  source: /note="Description of Unknown: Exemplary gene or splice site sequence"
uuggugaaga

SEQ ID NO: 3661 - RNA, 10 nt, Unknown
  source: /note="Description of Unknown: Exemplary gene or splice site sequence"
aggguaaugg

SEQ ID NO: 3662 - RNA, 10 nt, Unknown
  source: /note="Description of Unknown: Exemplary gene or splice site sequence"
cagguaacgc

SEQ ID NO: 3663 - RNA, 10 nt, Unknown
  source: /note="Description of Unknown: Exemplary gene or splice site sequence"
cugguacacu

SEQ ID NO: 3664 - RNA, 10 nt, Unknown
  source: /note="Description of Unknown: Exemplary gene or splice site sequence"
cagguacuug

SEQ ID NO: 3665 - RNA, 10 nt, Unknown
  source: /note="Description of Unknown: Exemplary gene or splice site sequence"
cacguaagua

SEQ ID NO: 3666 - RNA, 10 nt, Unknown
  source: /note="Description of Unknown: Exemplary gene or splice site sequence"
guggugcggc

SEQ ID NO: 3667 - RNA, 10 nt, Unknown
  source: /note="Description of Unknown: Exemplary gene or splice site sequence"
gaggucaguu

SEQ ID NO: 3668 - RNA, 10 nt, Unknown
  source: /note="Description of Unknown: Exemplary gene or splice site sequence"
guuguaggua

SEQ ID NO: 3669 - RNA, 10 nt, Unknown
  source: /note="Description of Unknown: Exemplary gene or splice site sequence"
uggguacaag

SEQ ID NO: 3670 - RNA, 10 nt, Unknown
  source: /note="Description of Unknown: Exemplary gene or splice site sequence"
auggcaagua

SEQ ID NO: 3671 - RNA, 10 nt, Unknown
  source: /note="Description of Unknown: Exemplary gene or splice site sequence"
gcggugagag

SEQ ID NO: 3672 - RNA, 10 nt, Unknown
  source: /note="Description of Unknown: Exemplary gene or splice site sequence"
aaggugcuuc

SEQ ID NO: 3673 - RNA, 10 nt, Unknown
  source: /note="Description of Unknown: Exemplary gene or splice site sequence"
uagguacauc

SEQ ID NO: 3674 - RNA, 10 nt, Unknown
  source: /note="Description of Unknown: Exemplary gene or splice site sequence"
acugugguaa

SEQ ID NO: 3675 - RNA, 10 nt, Unknown
  source: /note="Description of Unknown: Exemplary gene or splice site sequence"
gagguaugca

SEQ ID NO: 3676 - RNA, 10 nt, Unknown
  source: /note="Description of Unknown: Exemplary gene or splice site sequence"
aggguaguuc

SEQ ID NO: 3677 - RNA, 10 nt, Unknown
  source: /note="Description of Unknown: Exemplary gene or splice site sequence"
cagguuggga

SEQ ID NO: 3678 - RNA, 10 nt, Unknown
  source: /note="Description of Unknown: Exemplary gene or splice site sequence"
cagguggaua

SEQ ID NO: 3679 - RNA, 10 nt, Unknown
  source: /note="Description of Unknown: Exemplary gene or splice site sequence"
gagguaggau

SEQ ID NO: 3680 - RNA, 10 nt, Unknown
  source: /note="Description of Unknown: Exemplary gene or splice site sequence"
gggguuugug

SEQ ID NO: 3681 - RNA, 10 nt, Unknown
  source: /note="Description of Unknown: Exemplary gene or splice site sequence"
uagguaauug

SEQ ID NO: 3682 - RNA, 10 nt, Unknown
  source: /note="Description of Unknown: Exemplary gene or splice site sequence"
acgguaagaa

SEQ ID NO: 3683 - RNA, 10 nt, Unknown
  source: /note="Description of Unknown: Exemplary gene or splice site sequence"
ucgguacagg

SEQ ID NO: 3684 - RNA, 10 nt, Unknown
  source: /note="Description of Unknown: Exemplary gene or splice site sequence"
caaguaagcg

SEQ ID NO: 3685 - RNA, 10 nt, Unknown
  source: /note="Description of Unknown: Exemplary gene or splice site sequence"
aagguccgcg

SEQ ID NO: 3686 - RNA, 10 nt, Unknown
  source: /note="Description of Unknown: Exemplary gene or splice site sequence"
caggugaaug

SEQ ID NO: 3687 - RNA, 10 nt, Unknown
  source: /note="Description of Unknown: Exemplary gene or splice site sequence"
ucuguauguc

SEQ ID NO: 3688 - RNA, 10 nt, Unknown
  source: /note="Description of Unknown: Exemplary gene or splice site sequence"
ucgguuagua

SEQ ID NO: 3689 - RNA, 10 nt, Unknown
  source: /note="Description of Unknown: Exemplary gene or splice site sequence"
gauguaugca

SEQ ID NO: 3690 - RNA, 10 nt, Unknown
  source: /note="Description of Unknown: Exemplary gene or splice site sequence"
gagguuggug

SEQ ID NO: 3691 - RNA, 10 nt, Unknown
  source: /note="Description of Unknown: Exemplary gene or splice site sequence"
ugggucaguc

SEQ ID NO: 3692 - RNA, 10 nt, Unknown
  source: /note="Description of Unknown: Exemplary gene or splice site sequence"
cagguugcuu

SEQ ID NO: 3693 - RNA, 10 nt, Unknown
  source: /note="Description of Unknown: Exemplary gene or splice site sequence"
aggguagagu

SEQ ID NO: 3694 - RNA, 10 nt, Unknown
  source: /note="Description of Unknown: Exemplary gene or splice site sequence"
cgcguaugua

SEQ ID NO: 3695 - RNA, 10 nt, Unknown
  source: /note="Description of Unknown: Exemplary gene or splice site sequence"
gagguauuaa

SEQ ID NO: 3696 - RNA, 10 nt, Unknown
  source: /note="Description of Unknown: Exemplary gene or splice site sequence"
cagguaaacu

SEQ ID NO: 3697 - RNA, 10 nt, Unknown
  source: /note="Description of Unknown: Exemplary gene or splice site sequence"
ggggucuggc

SEQ ID NO: 3698 - RNA, 10 nt, Unknown
  source: /note="Description of Unknown: Exemplary gene or splice site sequence"
gcuguggggu

SEQ ID NO: 3699 - RNA, 10 nt, Unknown
  source: /note="Description of Unknown: Exemplary gene or splice site sequence"
uugguaaguc

SEQ ID NO: 3700 - RNA, 10 nt, Unknown
  source: /note="Description of Unknown: Exemplary gene or splice site sequence"
aagguagaag

SEQ ID NO: 3701 - RNA, 10 nt, Unknown
  source: /note="Description of Unknown: Exemplary gene or splice site sequence"
auggugagga

SEQ ID NO: 3702 - RNA, 10 nt, Unknown
  source: /note="Description of Unknown: Exemplary gene or splice site sequence"
ccgguacagc

SEQ ID NO: 3703 - RNA, 10 nt, Unknown
  source: /note="Description of Unknown: Exemplary gene or splice site sequence"
gcggugcgga

SEQ ID NO: 3704 - RNA, 10 nt, Unknown
  source: /note="Description of Unknown: Exemplary gene or splice site sequence"
aacguagguu

SEQ ID NO: 3705 - RNA, 10 nt, Unknown
  source: /note="Description of Unknown: Exemplary gene or splice site sequence"
uugguacuau

SEQ ID NO: 3706 - RNA, 10 nt, Unknown
  source: /note="Description of Unknown: Exemplary gene or splice site sequence"
caggcauggg

SEQ ID NO: 3707 - RNA, 10 nt, Unknown
  source: /note="Description of Unknown: Exemplary gene or splice site sequence"
caggugggcg

SEQ ID NO: 3708 - RNA, 10 nt, Unknown
  source: /note="Description of Unknown: Exemplary gene or splice site sequence"
cacgugagga

SEQ ID NO: 3709 - RNA, 10 nt, Unknown
  source: /note="Description of Unknown: Exemplary gene or splice site sequence"
ugggcauucu

SEQ ID NO: 3710 - RNA, 10 nt, Unknown
  source: /note="Description of Unknown: Exemplary gene or splice site sequence"
agaguacgua

SEQ ID NO: 3711 - RNA, 10 nt, Unknown
  source: /note="Description of Unknown: Exemplary gene or splice site sequence"
aagguauuca

SEQ ID NO: 3712 - RNA, 10 nt, Unknown
  source: /note="Description of Unknown: Exemplary gene or splice site sequence"
gaggucuaca

SEQ ID NO: 3713 - RNA, 10 nt, Unknown
  source: /note="Description of Unknown: Exemplary gene or splice site sequence"
guuguagguc

SEQ ID NO: 3714 - RNA, 10 nt, Unknown
  source: /note="Description of Unknown: Exemplary gene or splice site sequence"
cagguacucg

SEQ ID NO: 3715 - RNA, 10 nt, Unknown
  source: /note="Description of Unknown: Exemplary gene or splice site sequence"
gucguauguu

SEQ ID NO: 3716 - RNA, 10 nt, Unknown
  source: /note="Description of Unknown: Exemplary gene or splice site sequence"
aguguuggua

SEQ ID NO: 3717 - RNA, 10 nt, Unknown
  source: /note="Description of Unknown: Exemplary gene or splice site sequence"
aagguagauu

SEQ ID NO: 3718 - RNA, 10 nt, Unknown
  source: /note="Description of Unknown: Exemplary gene or splice site sequence"
gaggccccag

SEQ ID NO: 3719 - RNA, 10 nt, Unknown
  source: /note="Description of Unknown: Exemplary gene or splice site sequence"
auggucaguu

SEQ ID NO: 3720 - RNA, 10 nt, Unknown
  source: /note="Description of Unknown: Exemplary gene or splice site sequence"
ucuguaagga

SEQ ID NO: 3721 - RNA, 10 nt, Unknown
  source: /note="Description of Unknown: Exemplary gene or splice site sequence"
caggucgggc

SEQ ID NO: 3722 - RNA, 10 nt, Unknown
  source: /note="Description of Unknown: Exemplary gene or splice site sequence"
cugguacuuc

SEQ ID NO: 3723 - RNA, 10 nt, Unknown
  source: /note="Description of Unknown: Exemplary gene or splice site sequence"
uggguccgua

SEQ ID NO: 3724 - RNA, 10 nt, Unknown
  source: /note="Description of Unknown: Exemplary gene or splice site sequence"
gagguugugc

SEQ ID NO: 3725 - RNA, 10 nt, Unknown
  source: /note="Description of Unknown: Exemplary gene or splice site sequence"
aaaguauggc

SEQ ID NO: 3726 - RNA, 10 nt, Unknown
  source: /note="Description of Unknown: Exemplary gene or splice site sequence"
cugguacgga

SEQ ID NO: 3727 - RNA, 10 nt, Unknown
  source: /note="Description of Unknown: Exemplary gene or splice site sequence"
caagugaccu

SEQ ID NO: 3728 - RNA, 10 nt, Unknown
  source: /note="Description of Unknown: Exemplary gene or splice site sequence"
aaggucugca

SEQ ID NO: 3729 - RNA, 10 nt, Unknown
  source: /note="Description of Unknown: Exemplary gene or splice site sequence"
aaggugaccu

SEQ ID NO: 3730 - RNA, 10 nt, Unknown
  source: /note="Description of Unknown: Exemplary gene or splice site sequence"
caggcagguc

SEQ ID NO: 3731 - RNA, 10 nt, Unknown
  source: /note="Description of Unknown: Exemplary gene or splice site sequence"
ucagcaguga

SEQ ID NO: 3732 - RNA, 10 nt, Unknown
  source: /note="Description of Unknown: Exemplary gene or splice site sequence"
aagguaccac

SEQ ID NO: 3733 - RNA, 10 nt, Unknown
  source: /note="Description of Unknown: Exemplary gene or splice site sequence"
uaaguaggug

SEQ ID NO: 3734 - RNA, 10 nt, Unknown
  source: /note="Description of Unknown: Exemplary gene or splice site sequence"
caggugucgg

SEQ ID NO: 3735 - RNA, 10 nt, Unknown
  source: /note="Description of Unknown: Exemplary gene or splice site sequence"
cagguggcua

SEQ ID NO: 3736 - RNA, 10 nt, Unknown
  source: /note="Description of Unknown: Exemplary gene or splice site sequence"
gagguugcca

SEQ ID NO: 3737 - RNA, 10 nt, Unknown
  source: /note="Description of Unknown: Exemplary gene or splice site sequence"
caggccgugg

SEQ ID NO: 3738 - RNA, 10 nt, Unknown
  source: /note="Description of Unknown: Exemplary gene or splice site sequence"
uugguauaug

SEQ ID NO: 3739 - RNA, 10 nt, Unknown
  source: /note="Description of Unknown: Exemplary gene or splice site sequence"
gagguugagu

SEQ ID NO: 3740 - RNA, 10 nt, Unknown
  source: /note="Description of Unknown: Exemplary gene or splice site sequence"
gagguagguc

SEQ ID NO: 3741 - RNA, 10 nt, Unknown
  source: /note="Description of Unknown: Exemplary gene or splice site sequence"
uagguccuuc

SEQ ID NO: 3742 - RNA, 10 nt, Unknown
  source: /note="Description of Unknown: Exemplary gene or splice site sequence"
gaggcaaguc

SEQ ID NO: 3743 - RNA, 10 nt, Unknown
  source: /note="Description of Unknown: Exemplary gene or splice site sequence"
gagguaacau

SEQ ID NO: 3744 - RNA, 10 nt, Unknown
  source: /note="Description of Unknown: Exemplary gene or splice site sequence"
ucgguugguu

SEQ ID NO: 3745 - RNA, 10 nt, Unknown
  source: /note="Description of Unknown: Exemplary gene or splice site sequence"
caggugaacc

SEQ ID NO: 3746 - RNA, 10 nt, Unknown
  source: /note="Description of Unknown: Exemplary gene or splice site sequence"
caggucuuuu

SEQ ID NO: 3747 - RNA, 10 nt, Unknown
  source: /note="Description of Unknown: Exemplary gene or splice site sequence"
caggcauggc

SEQ ID NO: 3748 - RNA, 10 nt, Unknown
  source: /note="Description of Unknown: Exemplary gene or splice site sequence"
uugguagguu

SEQ ID NO: 3749 - RNA, 10 nt, Unknown
  source: /note="Description of Unknown: Exemplary gene or splice site sequence"
uaugugagca

SEQ ID NO: 3750 - RNA, 10 nt, Unknown
  source: /note="Description of Unknown: Exemplary gene or splice site sequence"
aauguaauaa

SEQ ID NO: 3751 - RNA, 10 nt, Unknown
  source: /note="Description of Unknown: Exemplary gene or splice site sequence"
aaaguaaggc

SEQ ID NO: 3752 - RNA, 10 nt, Unknown
  source: /note="Description of Unknown: Exemplary gene or splice site sequence"
gagguaaguu

SEQ ID NO: 3753 - RNA, 10 nt, Unknown
  source: /note="Description of Unknown: Exemplary gene or splice site sequence"
aagguagccg

SEQ ID NO: 3754 - RNA, 10 nt, Unknown
  source: /note="Description of Unknown: Exemplary gene or splice site sequence"
cagguggugc

SEQ ID NO: 3755 - RNA, 10 nt, Unknown
  source: /note="Description of Unknown: Exemplary gene or splice site sequence"
ugagucaguu

SEQ ID NO: 3756 - RNA, 10 nt, Unknown
  source: /note="Description of Unknown: Exemplary gene or splice site sequence"
cugguaggcc

SEQ ID NO: 3757 - RNA, 10 nt, Unknown
  source: /note="Description of Unknown: Exemplary gene or splice site sequence"
caaguaagga

SEQ ID NO: 3758 - RNA, 10 nt, Unknown
  source: /note="Description of Unknown: Exemplary gene or splice site sequence"
cggguaaggc

SEQ ID NO: 3759 - RNA, 10 nt, Unknown
  source: /note="Description of Unknown: Exemplary gene or splice site sequence"
aaggcgagga

SEQ ID NO: 3760 - RNA, 10 nt, Unknown
  source: /note="Description of Unknown: Exemplary gene or splice site sequence"
ccgguaauua

SEQ ID NO: 3761 - RNA, 10 nt, Unknown
  source: /note="Description of Unknown: Exemplary gene or splice site sequence"
aaggugguca

SEQ ID NO: 3762 - RNA, 10 nt, Unknown
  source: /note="Description of Unknown: Exemplary gene or splice site sequence"
aucguaagua

SEQ ID NO: 3763 - RNA, 10 nt, Unknown
  source: /note="Description of Unknown: Exemplary gene or splice site sequence"
ccgguacaua

SEQ ID NO: 3764 - RNA, 10 nt, Unknown
  source: /note="Description of Unknown: Exemplary gene or splice site sequence"
gcggugagug

SEQ ID NO: 3765 - RNA, 10 nt, Unknown
  source: /note="Description of Unknown: Exemplary gene or splice site sequence"
cuggugugga

SEQ ID NO: 3766 - RNA, 10 nt, Unknown
  source: /note="Description of Unknown: Exemplary gene or splice site sequence"
gagguaauuc

SEQ ID NO: 3767 - RNA, 10 nt, Unknown
  source: /note="Description of Unknown: Exemplary gene or splice site sequence"
caaguacgua

SEQ ID NO: 3768 - RNA, 10 nt, Unknown
  source: /note="Description of Unknown: Exemplary gene or splice site sequence"
uagguuagga

SEQ ID NO: 3769 - RNA, 10 nt, Unknown
  source: /note="Description of Unknown: Exemplary gene or splice site sequence"
auggcaggug

SEQ ID NO: 3770 - RNA, 10 nt, Unknown
  source: /note="Description of Unknown: Exemplary gene or splice site sequence"
uaggcaagua

SEQ ID NO: 3771 - RNA, 10 nt, Unknown
  source: /note="Description of Unknown: Exemplary gene or splice site sequence"
gcagcccgca

SEQ ID NO: 3772 - RNA, 10 nt, Unknown
  source: /note="Description of Unknown: Exemplary gene or splice site sequence"
acgguaaacu

SEQ ID NO: 3773 - RNA, 10 nt, Unknown
  source: /note="Description of Unknown: Exemplary gene or splice site sequence"
guaguagucu

SEQ ID NO: 3774 - RNA, 10 nt, Unknown
  source: /note="Description of Unknown: Exemplary gene or splice site sequence"
guggcugaaa

SEQ ID NO: 3775 - RNA, 10 nt, Unknown
  source: /note="Description of Unknown: Exemplary gene or splice site sequence"
aaagugauug

SEQ ID NO: 3776 - RNA, 10 nt, Unknown
  source: /note="Description of Unknown: Exemplary gene or splice site sequence"
uaggucugga

SEQ ID NO: 3777 - RNA, 10 nt, Unknown
  source: /note="Description of Unknown: Exemplary gene or splice site sequence"
gagguguuuc

SEQ ID NO: 3778 - RNA, 10 nt, Unknown
  source: /note="Description of Unknown: Exemplary gene or splice site sequence"
cauguacauc

SEQ ID NO: 3779 - RNA, 10 nt, Unknown
  source: /note="Description of Unknown: Exemplary gene or splice site sequence"
aagguuugaa

SEQ ID NO: 3780 - RNA, 10 nt, Unknown
  source: /note="Description of Unknown: Exemplary gene or splice site sequence"
ccagcaagug

SEQ ID NO: 3781 - RNA, 10 nt, Unknown
  source: /note="Description of Unknown: Exemplary gene or splice site sequence"
uagguaauaa

SEQ ID NO: 3782 - RNA, 10 nt, Unknown
  source: /note="Description of Unknown: Exemplary gene or splice site sequence"
caggucgugg

SEQ ID NO: 3783 - RNA, 10 nt, Unknown
  source: /note="Description of Unknown: Exemplary gene or splice site sequence"
gaaguaugcc

SEQ ID NO: 3784 - RNA, 10 nt, Unknown
  source: /note="Description of Unknown: Exemplary gene or splice site sequence"
ucggugcccu

SEQ ID NO: 3785 - RNA, 10 nt, Unknown
  source: /note="Description of Unknown: Exemplary gene or splice site sequence"
gaggucaguc

SEQ ID NO: 3786 - RNA, 10 nt, Unknown
  source: /note="Description of Unknown: Exemplary gene or splice site sequence"
uuugucugua

SEQ ID NO: 3787 - RNA, 10 nt, Unknown
  source: /note="Description of Unknown: Exemplary gene or splice site sequence"
cagguagaua

SEQ ID NO: 3788 - RNA, 10 nt, Unknown
  source: /note="Description of Unknown: Exemplary gene or splice site sequence"
uggguaucag

SEQ ID NO: 3789 - RNA, 10 nt, Unknown
  source: /note="Description of Unknown: Exemplary gene or splice site sequence"
auggugagau

SEQ ID NO: 3790 - RNA, 10 nt, Unknown
  source: /note="Description of Unknown: Exemplary gene or splice site sequence"
cagguaacac

SEQ ID NO: 3791 - RNA, 10 nt, Unknown
  source: /note="Description of Unknown: Exemplary gene or splice site sequence"
ccgguauccu

SEQ ID NO: 3792 - RNA, 10 nt, Unknown
  source: /note="Description of Unknown: Exemplary gene or splice site sequence"
ucaguacauc

SEQ ID NO: 3793 - RNA, 10 nt, Unknown
  source: /note="Description of Unknown: Exemplary gene or splice site sequence"
uugguaagac

SEQ ID NO: 3794 - RNA, 10 nt, Unknown
  source: /note="Description of Unknown: Exemplary gene or splice site sequence"
ccgguuaguc

SEQ ID NO: 3795 - RNA, 10 nt, Unknown
  source: /note="Description of Unknown: Exemplary gene or splice site sequence"
acaguauguc

SEQ ID NO: 3796 - RNA, 10 nt, Unknown
  source: /note="Description of Unknown: Exemplary gene or splice site sequence"
cagguauuaa

SEQ ID NO: 3797 - RNA, 10 nt, Unknown
  source: /note="Description of Unknown: Exemplary gene or splice site sequence"
cagguggauc

SEQ ID NO: 3798 - RNA, 10 nt, Unknown
  source: /note="Description of Unknown: Exemplary gene or splice site sequence"
agagugcgua

SEQ ID NO: 3799 - RNA, 10 nt, Unknown
  source: /note="Description of Unknown: Exemplary gene or splice site sequence"
aaggugaccg

SEQ ID NO: 3800 - RNA, 10 nt, Unknown
  source: /note="Description of Unknown: Exemplary gene or splice site sequence"
acuguaugua

SEQ ID NO: 3801 - RNA, 10 nt, Unknown
  source: /note="Description of Unknown: Exemplary gene or splice site sequence"
uaggucaauu

SEQ ID NO: 3802 - RNA, 10 nt, Unknown
  source: /note="Description of Unknown: Exemplary gene or splice site sequence"
aguguguaag

SEQ ID NO: 3803 - RNA, 10 nt, Unknown
  source: /note="Description of Unknown: Exemplary gene or splice site sequence"
cggguaccuu

SEQ ID NO: 3804 - RNA, 10 nt, Unknown
  source: /note="Description of Unknown: Exemplary gene or splice site sequence"
cuagugaguu

SEQ ID NO: 3805 - RNA, 10 nt, Unknown
  source: /note="Description of Unknown: Exemplary gene or splice site sequence"
cagguacaac

SEQ ID NO: 3806 - RNA, 10 nt, Unknown
  source: /note="Description of Unknown: Exemplary gene or splice site sequence"
cauguacggc

SEQ ID NO: 3807 - RNA, 10 nt, Unknown
  source: /note="Description of Unknown: Exemplary gene or splice site sequence"
auggugugag

SEQ ID NO: 3808 - RNA, 10 nt, Unknown
  source: /note="Description of Unknown: Exemplary gene or splice site sequence"
aggguggaag

SEQ ID NO: 3809 - RNA, 10 nt, Unknown
  source: /note="Description of Unknown: Exemplary gene or splice site sequence"
caggugcgag

SEQ ID NO: 3810 - RNA, 10 nt, Unknown
  source: /note="Description of Unknown: Exemplary gene or splice site sequence"
uaggugcucc

SEQ ID NO: 3811 - RNA, 10 nt, Unknown
  source: /note="Description of Unknown: Exemplary gene or splice site sequence"
cagguuuuua

SEQ ID NO: 3812 - RNA, 10 nt, Unknown
  source: /note="Description of Unknown: Exemplary gene or splice site sequence"
aacgugaggu

SEQ ID NO: 3813 - RNA, 10 nt, Unknown
  source: /note="Description of Unknown: Exemplary gene or splice site sequence"
cggguaagag

SEQ ID NO: 3814 - RNA, 10 nt, Unknown
  source: /note="Description of Unknown: Exemplary gene or splice site sequence"
uuugucggua

SEQ ID NO: 3815 - RNA, 10 nt, Unknown
  source: /note="Description of Unknown: Exemplary gene or splice site sequence"
uagguuaagu

SEQ ID NO: 3816 - RNA, 10 nt, Unknown
  source: /note="Description of Unknown: Exemplary gene or splice site sequence"
ucgguaaaua

SEQ ID NO: 3817 - RNA, 10 nt, Unknown
  source: /note="Description of Unknown: Exemplary gene or splice site sequence"
ccugugagua

SEQ ID NO: 3818 - RNA, 10 nt, Unknown
  source: /note="Description of Unknown: Exemplary gene or splice site sequence"
cagguuauau

SEQ ID NO: 3819 - RNA, 10 nt, Unknown
  source: /note="Description of Unknown: Exemplary gene or splice site sequence"
cuggugaaca

SEQ ID NO: 3820 - RNA, 10 nt, Unknown
  source: /note="Description of Unknown: Exemplary gene or splice site sequence"
uuugugagua

SEQ ID NO: 3821 - RNA, 10 nt, Unknown
  source: /note="Description of Unknown: Exemplary gene or splice site sequence"
cuuguacgcc

SEQ ID NO: 3822 - RNA, 10 nt, Unknown
  source: /note="Description of Unknown: Exemplary gene or splice site sequence"
ugagcccugc

SEQ ID NO: 3823 - RNA, 10 nt, Unknown
  source: /note="Description of Unknown: Exemplary gene or splice site sequence"
uguguaugua

SEQ ID NO: 3824 - RNA, 10 nt, Unknown
  source: /note="Description of Unknown: Exemplary gene or splice site sequence"
aagguagagg

SEQ ID NO: 3825 - RNA, 10 nt, Unknown
  source: /note="Description of Unknown: Exemplary gene or splice site sequence"
aaggcauggu

SEQ ID NO: 3826 - RNA, 10 nt, Unknown
  source: /note="Description of Unknown: Exemplary gene or splice site sequence"
acuguaauug

SEQ ID NO: 3827 - RNA, 10 nt, Unknown
  source: /note="Description of Unknown: Exemplary gene or splice site sequence"
ucgguaccga

SEQ ID NO: 3828 - RNA, 10 nt, Unknown
  source: /note="Description of Unknown: Exemplary gene or splice site sequence"
cuggugagag

SEQ ID NO: 3829 - RNA, 10 nt, Unknown
  source: /note="Description of Unknown: Exemplary gene or splice site sequence"
augguaccac

SEQ ID NO: 3830 - RNA, 10 nt, Unknown
  source: /note="Description of Unknown: Exemplary gene or splice site sequence"
uaaguuaguu

SEQ ID NO: 3831 - RNA, 10 nt, Unknown
  source: /note="Description of Unknown: Exemplary gene or splice site sequence"
agagugaggc

SEQ ID NO: 3832 - RNA, 10 nt, Unknown
  source: /note="Description of Unknown: Exemplary gene or splice site sequence"
cgagucagua

SEQ ID NO: 3833 - RNA, 10 nt, Unknown
  source: /note="Description of Unknown: Exemplary gene or splice site sequence"
gagguggugg

SEQ ID NO: 3834 - RNA, 10 nt, Unknown
  source: /note="Description of Unknown: Exemplary gene or splice site sequence"
acgguauugg

SEQ ID NO: 3835 - RNA, 10 nt, Unknown
  source: /note="Description of Unknown: Exemplary gene or splice site sequence"
gcugcgagua

SEQ ID NO: 3836 - RNA, 10 nt, Unknown
  source: /note="Description of Unknown: Exemplary gene or splice site sequence"
gggguuugau

SEQ ID NO: 3837 - RNA, 10 nt, Unknown
  source: /note="Description of Unknown: Exemplary gene or splice site sequence"
cuggcaggug

SEQ ID NO: 3838 - RNA, 10 nt, Unknown
  source: /note="Description of Unknown: Exemplary gene or splice site sequence"
gcugucuguu

SEQ ID NO: 3839 - RNA, 10 nt, Unknown
  source: /note="Description of Unknown: Exemplary gene or splice site sequence"
gagguaacgg

SEQ ID NO: 3840 - RNA, 10 nt, Unknown
  source: /note="Description of Unknown: Exemplary gene or splice site sequence"
cugguauucu

SEQ ID NO: 3841 - RNA, 10 nt, Unknown
  source: /note="Description of Unknown: Exemplary gene or splice site sequence"
gugguaaacu

SEQ ID NO: 3842 - RNA, 10 nt, Unknown
  source: /note="Description of Unknown: Exemplary gene or splice site sequence"
gaggcgagcg

SEQ ID NO: 3843 - RNA, 10 nt, Unknown
  source: /note="Description of Unknown: Exemplary gene or splice site sequence"
uguguaagcg

SEQ ID NO: 3844 - RNA, 10 nt, Unknown
  source: /note="Description of Unknown: Exemplary gene or splice site sequence"
acaguaugug

SEQ ID NO: 3845 - RNA, 10 nt, Unknown
  source: /note="Description of Unknown: Exemplary gene or splice site sequence"
ccggugggga

SEQ ID NO: 3846 - RNA, 10 nt, Unknown
  source: /note="Description of Unknown: Exemplary gene or splice site sequence"
gaggucagug

SEQ ID NO: 3847 - RNA, 10 nt, Unknown
  source: /note="Description of Unknown: Exemplary gene or splice site sequence"
aggguaaggu

SEQ ID NO: 3848 - RNA, 10 nt, Unknown
  source: /note="Description of Unknown: Exemplary gene or splice site sequence"
gguguaaggu

SEQ ID NO: 3849 - RNA, 10 nt, Unknown
  source: /note="Description of Unknown: Exemplary gene or splice site sequence"
cagguauucc

SEQ ID NO: 3850 - RNA, 10 nt, Unknown
  source: /note="Description of Unknown: Exemplary gene or splice site sequence"
cugguauaaa

SEQ ID NO: 3851 - RNA, 10 nt, Unknown
  source: /note="Description of Unknown: Exemplary gene or splice site sequence"
ccggucugug

SEQ ID NO: 3852 - RNA, 10 nt, Unknown
  source: /note="Description of Unknown: Exemplary gene or splice site sequence"
caaguccacc

SEQ ID NO: 3853 - RNA, 10 nt, Unknown
  source: /note="Description of Unknown: Exemplary gene or splice site sequence"
caaguuggug

SEQ ID NO: 3854 - RNA, 10 nt, Unknown
  source: /note="Description of Unknown: Exemplary gene or splice site sequence"
cagguaaaau

SEQ ID NO: 3855 - RNA, 10 nt, Unknown
  source: /note="Description of Unknown: Exemplary gene or splice site sequence"
acgguaagga

SEQ ID NO: 3856 - RNA, 10 nt, Unknown
  source: /note="Description of Unknown: Exemplary gene or splice site sequence"
uggguaauaa

SEQ ID NO: 3857 - RNA, 10 nt, Unknown
  source: /note="Description of Unknown: Exemplary gene or splice site sequence"
ccgguagguu

SEQ ID NO: 3858 - RNA, 10 nt, Unknown
  source: /note="Description of Unknown: Exemplary gene or splice site sequence"
agaguaugga

SEQ ID NO: 3859 - RNA, 10 nt, Unknown
  source: /note="Description of Unknown: Exemplary gene or splice site sequence"
cucgugaguc

SEQ ID NO: 3860 - RNA, 10 nt, Unknown
  source: /note="Description of Unknown: Exemplary gene or splice site sequence"
aaagccggug

SEQ ID NO: 3861 - RNA, 10 nt, Unknown
  source: /note="Description of Unknown: Exemplary gene or splice site sequence"
ccugugugag

SEQ ID NO: 3862 - RNA, 10 nt, Unknown
  source: /note="Description of Unknown: Exemplary gene or splice site sequence"
ccgguaaaug

SEQ ID NO: 3863 - RNA, 10 nt, Unknown
  source: /note="Description of Unknown: Exemplary gene or splice site sequence"
caggugaagc

SEQ ID NO: 3864 - RNA, 10 nt, Unknown
  source: /note="Description of Unknown: Exemplary gene or splice site sequence"
ucgguagguc

SEQ ID NO: 3865 - RNA, 10 nt, Unknown
  source: /note="Description of Unknown: Exemplary gene or splice site sequence"
cgggugaggc

SEQ ID NO: 3866 - RNA, 10 nt, Unknown
  source: /note="Description of Unknown: Exemplary gene or splice site sequence"
cauguccacc

SEQ ID NO: 3867 - RNA, 10 nt, Unknown
  source: /note="Description of Unknown: Exemplary gene or splice site sequence"
aaggugaccc

SEQ ID NO: 3868 - RNA, 10 nt, Unknown
  source: /note="Description of Unknown: Exemplary gene or splice site sequence"
cggguuagua

SEQ ID NO: 3869 - RNA, 10 nt, Unknown
  source: /note="Description of Unknown: Exemplary gene or splice site sequence"
gcgguaguaa

SEQ ID NO: 3870 - RNA, 10 nt, Unknown
  source: /note="Description of Unknown: Exemplary gene or splice site sequence"
gcuguaggua

SEQ ID NO: 3871 - RNA, 10 nt, Unknown
  source: /note="Description of Unknown: Exemplary gene or splice site sequence"
ccuguugagu

SEQ ID NO: 3872 - RNA, 10 nt, Unknown
  source: /note="Description of Unknown: Exemplary gene or splice site sequence"
aggguaagac

SEQ ID NO: 3873 - RNA, 10 nt, Unknown
  source: /note="Description of Unknown: Exemplary gene or splice site sequence"
uuuguaggca

SEQ ID NO: 3874 - RNA, 10 nt, Unknown
  source: /note="Description of Unknown: Exemplary gene or splice site sequence"
agggugagau

SEQ ID NO: 3875 - RNA, 10 nt, Unknown
  source: /note="Description of Unknown: Exemplary gene or splice site sequence"
auaguaaaga

SEQ ID NO: 3876 - RNA, 10 nt, Unknown
  source: /note="Description of Unknown: Exemplary gene or splice site sequence"
aaggugcagg

SEQ ID NO: 3877 - RNA, 10 nt, Unknown
  source: /note="Description of Unknown: Exemplary gene or splice site sequence"
gaggugauuu

SEQ ID NO: 3878 - RNA, 10 nt, Unknown
  source: /note="Description of Unknown: Exemplary gene or splice site sequence"
cagguuggcu

SEQ ID NO: 3879 - RNA, 10 nt, Unknown
  source: /note="Description of Unknown: Exemplary gene or splice site sequence"
cggguauggg

SEQ ID NO: 3880 - RNA, 10 nt, Unknown
  source: /note="Description of Unknown: Exemplary gene or splice site sequence"
augguccauc

SEQ ID NO: 3881 - RNA, 10 nt, Unknown
  source: /note="Description of Unknown: Exemplary gene or splice site sequence"
ccgguuggug

SEQ ID NO: 3882 - RNA, 10 nt, Unknown
  source: /note="Description of Unknown: Exemplary gene or splice site sequence"
ggaguaaguc

SEQ ID NO: 3883 - RNA, 10 nt, Unknown
  source: /note="Description of Unknown: Exemplary gene or splice site sequence"
uaugucuuug

SEQ ID NO: 3884 - RNA, 10 nt, Unknown
  source: /note="Description of Unknown: Exemplary gene or splice site sequence"
acgguacuuc

SEQ ID NO: 3885 - RNA, 10 nt, Unknown
  source: /note="Description of Unknown: Exemplary gene or splice site sequence"
aaggcacgcg

SEQ ID NO: 3886 - RNA, 10 nt, Unknown
  source: /note="Description of Unknown: Exemplary gene or splice site sequence"
cuugugggua

SEQ ID NO: 3887 - RNA, 10 nt, Unknown
  source: /note="Description of Unknown: Exemplary gene or splice site sequence"
gagguggaga

SEQ ID NO: 3888 - RNA, 10 nt, Unknown
  source: /note="Description of Unknown: Exemplary gene or splice site sequence"
gugguggcug

SEQ ID NO: 3889 - RNA, 10 nt, Unknown
  source: /note="Description of Unknown: Exemplary gene or splice site sequence"
aacgugagua

SEQ ID NO: 3890 - RNA, 10 nt, Unknown
  source: /note="Description of Unknown: Exemplary gene or splice site sequence"
gaagcuguaa

SEQ ID NO: 3891 - RNA, 10 nt, Unknown
  source: /note="Description of Unknown: Exemplary gene or splice site sequence"
cggguaucuu

SEQ ID NO: 3892 - RNA, 10 nt, Unknown
  source: /note="Description of Unknown: Exemplary gene or splice site sequence"
aauguacgca

SEQ ID NO: 3893 - RNA, 10 nt, Unknown
  source: /note="Description of Unknown: Exemplary gene or splice site sequence"
ccggugggua

SEQ ID NO: 3894 - RNA, 10 nt, Unknown
  source: /note="Description of Unknown: Exemplary gene or splice site sequence"
ugggugaggu

SEQ ID NO: 3895 - RNA, 10 nt, Unknown
  source: /note="Description of Unknown: Exemplary gene or splice site sequence"
ccugugaaua

SEQ ID NO: 3896 - RNA, 10 nt, Unknown
  source: /note="Description of Unknown: Exemplary gene or splice site sequence"
gcugugugug

SEQ ID NO: 3897 - RNA, 10 nt, Unknown
  source: /note="Description of Unknown: Exemplary gene or splice site sequence"
aggguaaugu

SEQ ID NO: 3898 - RNA, 10 nt, Unknown
  source: /note="Description of Unknown: Exemplary gene or splice site sequence"
accguaaguu

SEQ ID NO: 3899 - RNA, 10 nt, Unknown
  source: /note="Description of Unknown: Exemplary gene or splice site sequence"
cguguaagua

SEQ ID NO: 3900 - RNA, 10 nt, Unknown
  source: /note="Description of Unknown: Exemplary gene or splice site sequence"
gggguaaguc

SEQ ID NO: 3901 - RNA, 10 nt, Unknown
  source: /note="Description of Unknown: Exemplary gene or splice site sequence"
aauguaugau

SEQ ID NO: 3902 - RNA, 10 nt, Unknown
  source: /note="Description of Unknown: Exemplary gene or splice site sequence"
aaugugauua

SEQ ID NO: 3903 - RNA, 10 nt, Unknown
  source: /note="Description of Unknown: Exemplary gene or splice site sequence"
cagguccguc

SEQ ID NO: 3904 - RNA, 10 nt, Unknown
  source: /note="Description of Unknown: Exemplary gene or splice site sequence"
gaaguauuga

SEQ ID NO: 3905 - RNA, 10 nt, Unknown
  source: /note="Description of Unknown: Exemplary gene or splice site sequence"
caggucgguu

SEQ ID NO: 3906 - RNA, 10 nt, Unknown
  source: /note="Description of Unknown: Exemplary gene or splice site sequence"
uacgugagua

SEQ ID NO: 3907 - RNA, 10 nt, Unknown
  source: /note="Description of Unknown: Exemplary gene or splice site sequence"
uugguaagca

SEQ ID NO: 3908 - RNA, 10 nt, Unknown
  source: /note="Description of Unknown: Exemplary gene or splice site sequence"
gcggugaguc

SEQ ID NO: 3909 - RNA, 10 nt, Unknown
  source: /note="Description of Unknown: Exemplary gene or splice site sequence"
gaaguaaggg

SEQ ID NO: 3910 - RNA, 10 nt, Unknown
  source: /note="Description of Unknown: Exemplary gene or splice site sequence"
cgcgugaguu

SEQ ID NO: 3911 - RNA, 10 nt, Unknown
  source: /note="Description of Unknown: Exemplary gene or splice site sequence"
cagguacccc

SEQ ID NO: 3912 - RNA, 10 nt, Unknown
  source: /note="Description of Unknown: Exemplary gene or splice site sequence"
ucuguaagac

SEQ ID NO: 3913 - RNA, 10 nt, Unknown
  source: /note="Description of Unknown: Exemplary gene or splice site sequence"
aauguaagac

SEQ ID NO: 3914 - RNA, 10 nt, Unknown
  source: /note="Description of Unknown: Exemplary gene or splice site sequence"
caggcaaggg

SEQ ID NO: 3915 - RNA, 10 nt, Unknown
  source: /note="Description of Unknown: Exemplary gene or splice site sequence"
aaaguuuguc

SEQ ID NO: 3916 - RNA, 10 nt, Unknown
  source: /note="Description of Unknown: Exemplary gene or splice site sequence"
ucgguaaguc

SEQ ID NO: 3917 - RNA, 10 nt, Unknown
  source: /note="Description of Unknown: Exemplary gene or splice site sequence"
cuugugagau

SEQ ID NO: 3918 - RNA, 10 nt, Unknown
  source: /note="Description of Unknown: Exemplary gene or splice site sequence"
agagugagcu

SEQ ID NO: 3919 - RNA, 10 nt, Unknown
  source: /note="Description of Unknown: Exemplary gene or splice site sequence"
uaagugggga

SEQ ID NO: 3920 - RNA, 10 nt, Unknown
  source: /note="Description of Unknown: Exemplary gene or splice site sequence"
aggguaauca

SEQ ID NO: 3921 - RNA, 10 nt, Unknown
  source: /note="Description of Unknown: Exemplary gene or splice site sequence"
aagguucagc

SEQ ID NO: 3922 - RNA, 10 nt, Unknown
  source: /note="Description of Unknown: Exemplary gene or splice site sequence"
ccgguauauu

SEQ ID NO: 3923 - RNA, 10 nt, Unknown
  source: /note="Description of Unknown: Exemplary gene or splice site sequence"
accguaugug

SEQ ID NO: 3924 - RNA, 10 nt, Unknown
  source: /note="Description of Unknown: Exemplary gene or splice site sequence"
cagguauagu

SEQ ID NO: 3925 - RNA, 10 nt, Unknown
  source: /note="Description of Unknown: Exemplary gene or splice site sequence"
cagguauuac

SEQ ID NO: 3926 - RNA, 10 nt, Unknown
  source: /note="Description of Unknown: Exemplary gene or splice site sequence"
cuggugaugg

SEQ ID NO: 3927 - RNA, 10 nt, Unknown
  source: /note="Description of Unknown: Exemplary gene or splice site sequence"
ccggugagca

SEQ ID NO: 3928 - RNA, 10 nt, Unknown
  source: /note="Description of Unknown: Exemplary gene or splice site sequence"
aagguacugg

SEQ ID NO: 3929 - RNA, 10 nt, Unknown
  source: /note="Description of Unknown: Exemplary gene or splice site sequence"
gcggucagga

SEQ ID NO: 3930 - RNA, 10 nt, Unknown
  source: /note="Description of Unknown: Exemplary gene or splice site sequence"
cuggucaggg

SEQ ID NO: 3931 - RNA, 10 nt, Unknown
  source: /note="Description of Unknown: Exemplary gene or splice site sequence"
aaaguacguu

SEQ ID NO: 3932 - RNA, 10 nt, Unknown
  source: /note="Description of Unknown: Exemplary gene or splice site sequence"
aggguaagcu

SEQ ID NO: 3933 - RNA, 10 nt, Unknown
  source: /note="Description of Unknown: Exemplary gene or splice site sequence"
ccggccacca

SEQ ID NO: 3934 - RNA, 10 nt, Unknown
  source: /note="Description of Unknown: Exemplary gene or splice site sequence"
caggcgagca

SEQ ID NO: 3935 - RNA, 10 nt, Unknown
  source: /note="Description of Unknown: Exemplary gene or splice site sequence"
agaguaggau

SEQ ID NO: 3936 - RNA, 10 nt, Unknown
  source: /note="Description of Unknown: Exemplary gene or splice site sequence"
cugguuucaa

SEQ ID NO: 3937 - RNA, 10 nt, Unknown
  source: /note="Description of Unknown: Exemplary gene or splice site sequence"
gagguaaacu

SEQ ID NO: 3938 - RNA, 10 nt, Unknown
  source: /note="Description of Unknown: Exemplary gene or splice site sequence"
uugguaaucu

SEQ ID NO: 3939 - RNA, 10 nt, Unknown
  source: /note="Description of Unknown: Exemplary gene or splice site sequence"
agggcagaau

SEQ ID NO: 3940 - RNA, 10 nt, Unknown
  source: /note="Description of Unknown: Exemplary gene or splice site sequence"
gcugcaggug

SEQ ID NO: 3941 - RNA, 10 nt, Unknown
  source: /note="Description of Unknown: Exemplary gene or splice site sequence"
gaagcacgug

SEQ ID NO: 3942 - RNA, 10 nt, Unknown
  source: /note="Description of Unknown: Exemplary gene or splice site sequence"
cauguaaaca

SEQ ID NO: 3943 - RNA, 10 nt, Unknown
  source: /note="Description of Unknown: Exemplary gene or splice site sequence"
aggguagcua

SEQ ID NO: 3944 - RNA, 10 nt, Unknown
  source: /note="Description of Unknown: Exemplary gene or splice site sequence"
ggaguaugua

SEQ ID NO: 3945 - RNA, 10 nt, Unknown
  source: /note="Description of Unknown: Exemplary gene or splice site sequence"
aaaguacgga

SEQ ID NO: 3946 - RNA, 10 nt, Unknown
  source: /note="Description of Unknown: Exemplary gene or splice site sequence"
gggguaauug

SEQ ID NO: 3947 - RNA, 10 nt, Unknown
  source: /note="Description of Unknown: Exemplary gene or splice site sequence"
gugguacgua

SEQ ID NO: 3948 - RNA, 10 nt, Unknown
  source: /note="Description of Unknown: Exemplary gene or splice site sequence"
aagguacagc

SEQ ID NO: 3949 - RNA, 10 nt, Unknown
  source: /note="Description of Unknown: Exemplary gene or splice site sequence"
gaggugaaga

SEQ ID NO: 3950 - RNA, 10 nt, Unknown
  source: /note="Description of Unknown: Exemplary gene or splice site sequence"
ugaguagguc

SEQ ID NO: 3951 - RNA, 10 nt, Unknown
  source: /note="Description of Unknown: Exemplary gene or splice site sequence"
ucaguaagac

SEQ ID NO: 3952 - RNA, 10 nt, Unknown
  source: /note="Description of Unknown: Exemplary gene or splice site sequence"
aaggcaaaac

SEQ ID NO: 3953 - RNA, 10 nt, Unknown
  source: /note="Description of Unknown: Exemplary gene or splice site sequence"
gaggcugugc

SEQ ID NO: 3954 - RNA, 10 nt, Unknown
  source: /note="Description of Unknown: Exemplary gene or splice site sequence"
agaguauggu

SEQ ID NO: 3955 - RNA, 10 nt, Unknown
  source: /note="Description of Unknown: Exemplary gene or splice site sequence"
gcugcugagc

SEQ ID NO: 3956 - RNA, 10 nt, Unknown
  source: /note="Description of Unknown: Exemplary gene or splice site sequence"
uaggucagaa

SEQ ID NO: 3957 - RNA, 10 nt, Unknown
  source: /note="Description of Unknown: Exemplary gene or splice site sequence"
ccgguaggug

SEQ ID NO: 3958 - RNA, 10 nt, Unknown
  source: /note="Description of Unknown: Exemplary gene or splice site sequence"
gcaguaugau

SEQ ID NO: 3959 - RNA, 10 nt, Unknown
  source: /note="Description of Unknown: Exemplary gene or splice site sequence"
cagguuucag

(The sequence listing continues in the following parts.)

The invention claimed is:

1. A compound of Formula (I-a):

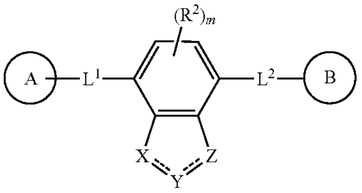

(I-a)

or a pharmaceutically acceptable salt, solvate, hydrate, tautomer, or stereoisomer thereof, wherein:

A is a nitrogen-containing heterocyclyl optionally substituted with one or more $R^1$;

B is a nitrogen-containing heteroaryl optionally substituted with one or more $R^1$;

X and Y are each independently $C(R^{3a})$, $C(R^{3a})(R^{3b})$, N, $N(R^{3c})$, or O, and the bonds in the ring comprising X, Y, and Z may be single or double bonds as valency permits;

Z is N, $N(R^{3c})$, or O;

$L^1$ is absent;

$L^2$ is —C(O)N($R^4$)—;

each $R^1$ is independently hydrogen, $C_1$-$C_6$-alkyl, $C_2$-$C_6$-alkenyl, $C_2$-$C_6$-alkynyl, $C_1$-$C_6$-heteroalkyl, $C_1$-$C_6$-haloalkyl, cycloalkyl, heterocyclyl, aryl, $C_1$-$C_6$ alkylene-aryl, $C_1$-$C_6$ alkenylene-aryl, $C_1$-$C_6$ alkylene-heteroaryl, heteroaryl, halo, cyano, oxo, —$OR^A$, —$NR^BR^C$, —$NR^BC(O)R^D$, —$NO_2$, —C(O)$NR^BR^C$, —C(O)$R^D$, —C(O)O$R^D$, —$SR^E$, or —$S(O)_x$ $R^D$, wherein each alkyl, alkylene, alkenyl, alkynyl, heteroalkyl, haloalkyl, cycloalkyl, heterocyclyl, aryl, and heteroaryl is optionally substituted with one or more $R^6$; or two $R^1$ groups, together with the atoms to which they are attached, form a 3-7-membered cycloalkyl, heterocyclyl, aryl, or heteroaryl, wherein each cycloalkyl, heterocyclyl, aryl, and heteroaryl is optionally substituted with one or more $R^6$;

each $R^2$ is independently hydrogen, $C_1$-$C_6$-alkyl, $C_2$-$C_6$-alkenyl, $C_2$-$C_6$-alkynyl, $C_1$-$C_6$-heteroalkyl, $C_1$-$C_6$-haloalkyl, halo, cyano, or —$OR^A$;

$R^{3a}$ and $R^{3b}$ are each independently hydrogen, $C_1$-$C_6$-alkyl, $C_1$-$C_6$-heteroalkyl, $C_1$-$C_6$-haloalkyl, halo, cyano, —$OR^A$, —$NR^BR^C$, —C(O)$R^D$, or —C(O)O$R^D$; or each of $R^{3a}$ and $R^{3b}$, together with the carbon atom to which they are attached, form an oxo group;

$R^{3c}$ is hydrogen or $C_1$-$C_6$-alkyl;

each $R^4$ is independently hydrogen, $C_1$-$C_6$-alkyl, or $C_1$-$C_6$-haloalkyl;

each $R^6$ is independently $C_1$-$C_6$-alkyl, $C_2$-$C_6$-alkenyl, $C_2$-$C_6$-alkynyl, $C_1$-$C_6$-heteroalkyl, $C_1$-$C_6$-haloalkyl, cycloalkyl, heterocyclyl, aryl, heteroaryl, halo, cyano, oxo, —$OR^A$, —$NR^BR^C$, —$NR^BC(O)R^D$, —$NO_2$, —C(O)$NR^BR^C$, —C(O)$R^D$, —C(O)O$R^D$, —$SR^E$, or —$S(O)_xR^D$, wherein each alkyl, alkenyl, alkynyl, heteroalkyl, haloalkyl, cycloalkyl, heterocyclyl, aryl, and heteroaryl is optionally substituted with one or more $R^{11}$;

each $R^7$ is $C_1$-$C_6$-alkyl, halo, cyano, oxo, or —$OR^{A1}$;

each $R^{11}$ is independently $C_1$-$C_6$-alkyl, $C_1$-$C_6$-heteroalkyl, $C_1$-$C_6$-haloalkyl, cycloalkyl, heterocyclyl, aryl, heteroaryl, halo, cyano, oxo, or —$OR^A$;

each $R^A$ is independently hydrogen, $C_1$-$C_6$ alkyl, $C_1$-$C_6$ haloalkyl, aryl, heteroaryl, $C_1$-$C_6$ alkylene-aryl, $C_1$-$C_6$ alkylene-heteroaryl, —C(O)$R^D$, or —$S(O)_x$ $R^D$;

each of $R^B$ and $R^C$ is independently hydrogen, $C_1$-$C_6$ alkyl, $C_1$-$C_6$ heteroalkyl, cycloalkyl, heterocyclyl, or —$OR^A$; or $R^B$ and $R^C$ together with the atom to which they are attached form a 3-7-membered heterocyclyl ring optionally substituted with one or more $R^7$;

each $R^D$ and $R^E$ is independently hydrogen, $C_1$-$C_6$ alkyl, $C_2$-$C_6$ alkenyl, $C_2$-$C_6$ alkynyl, $C_1$-$C_6$ heteroalkyl, $C_1$-$C_6$ haloalkyl, cycloalkyl, heterocyclyl, aryl, heteroaryl, $C_1$-$C_6$ alkylene-aryl, or $C_1$-$C_6$ alkylene-heteroaryl;

each $R^{A1}$ is hydrogen or $C_1$-$C_6$-alkyl;

m is 0, 1, or 2; and x is 0, 1, or 2.

2. The compound of claim 1, wherein A is a monocyclic or bicyclic heterocyclyl.

3. The compound of claim 1, wherein A is selected from

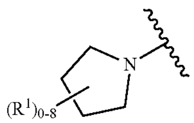,
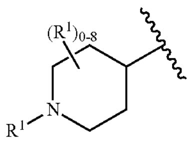,
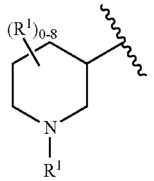,
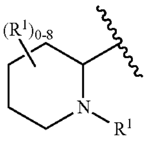,
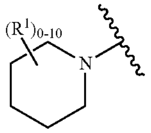,
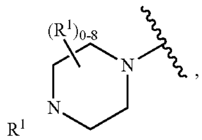,
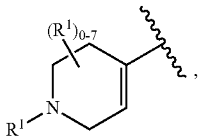,
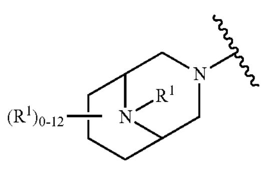,
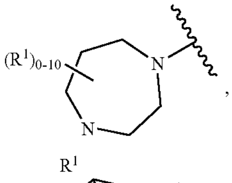,
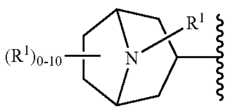,
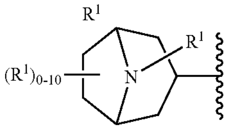,
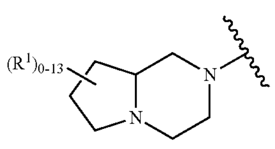, and
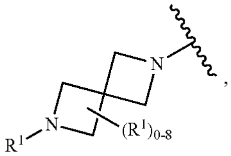, wherein $R^1$ is as defined in claim 1.

4. The compound of claim 1, wherein A is selected from

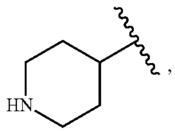, 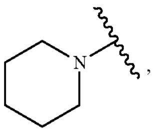, 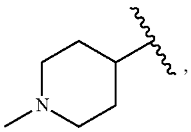, 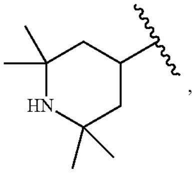, 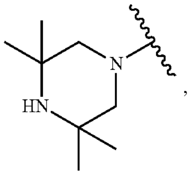, 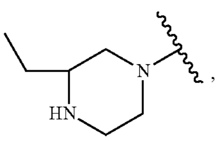, 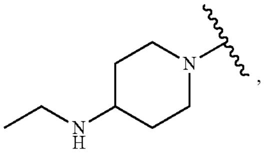, 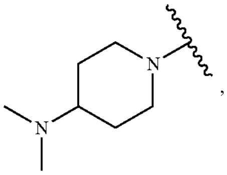, 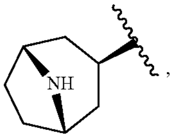, 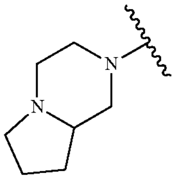, 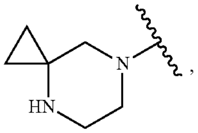, 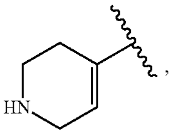, 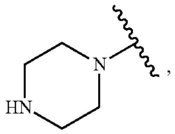, 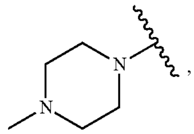, 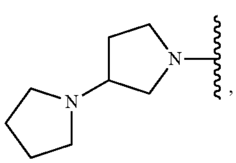, and 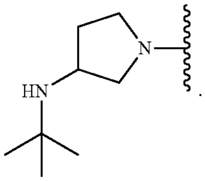.

5. The compound of claim 1, wherein B is selected from

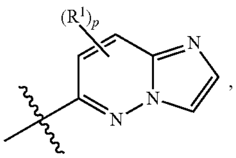, 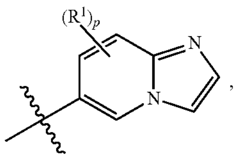, 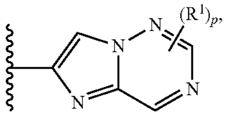 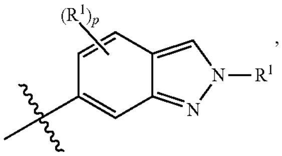,

-continued

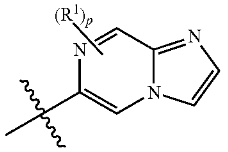, 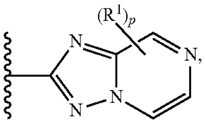 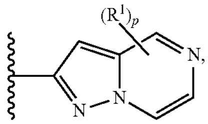 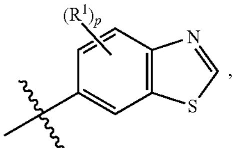, and 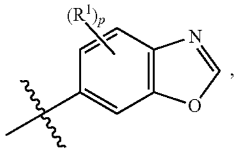, wherein $R^1$ is as defined in claim 1; and, p is 0, 1, 2, 3, or 4.

6. The compound of claim 1, wherein B is selected from

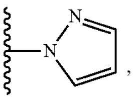, 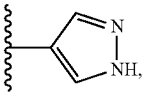 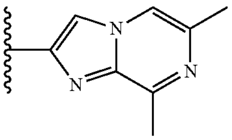, 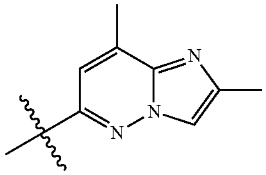, 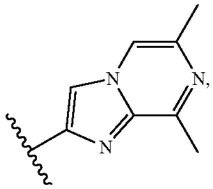 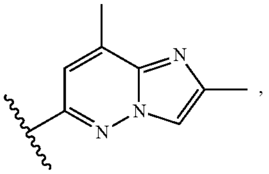, 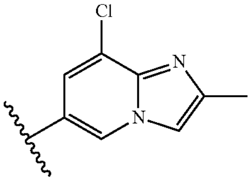, 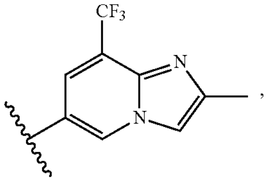, and 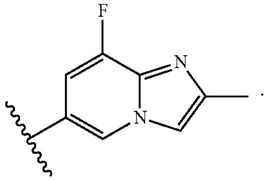.

7. The compound of claim 1, wherein one of X, Y, and Z is $C(R^{3a})$ and the others of X, Y, and Z are each independently O, N or $N(R^{3c})$.

8. The compound of claim 1, wherein at least one of X, Y, and Z is O.

9. The compound of claim 1, wherein Z and Y are each independently N or $N(R^{3c})$, and X is $C(R^{3a})$.

10. The compound of claim 1, wherein

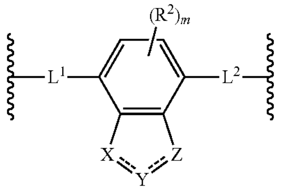

is selected from

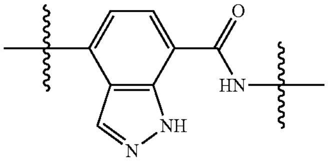
,

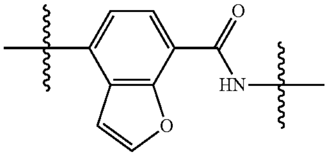
,

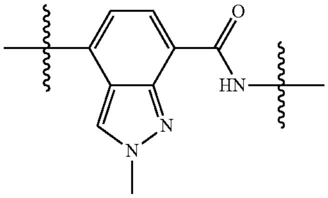
,

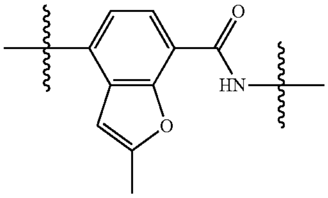
,

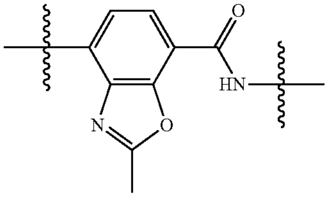
,

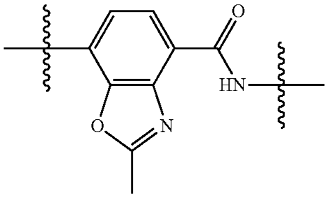
,

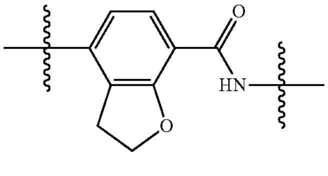
, and

-continued

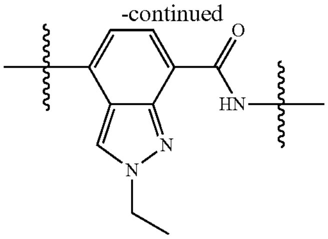
.

11. The compound of claim 1, wherein the compound of Formula (I-a) is Formula (I-b):

(I-b)

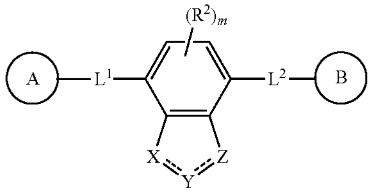

or a pharmaceutically acceptable salt, solvate, hydrate, tautomer, or stereoisomer thereof, wherein:

A is a nitrogen-containing heterocyclyl optionally substituted with one or more $R^1$;

B is a nitrogen-containing heteroaryl optionally substituted with one or more $R^1$;

X and Y are each independently $C(R^{3a})$, $C(R^{3a})(R^{3b})$, N, $N(R^{3c})$, or O, and the bonds in the ring comprising X, Y, and Z may be single or double bonds as valency permits;

Z is N, $N(R^{3c})$, or O;

$L^2$ is $C(O)N(R^4)$—;

each $R^1$ is independently hydrogen, $C_1$-$C_6$-alkyl, $C_2$-$C_6$-alkenyl, $C_2$-$C_6$-alkynyl, $C_1$-$C_6$-heteroalkyl, $C_1$-$C_6$-haloalkyl, cycloalkyl, heterocyclyl, aryl, $C_1$-$C_6$ alkylene-aryl, $C_1$-$C_6$ alkenylene-aryl, $C_1$-$C_6$ alkylene-heteroaryl, heteroaryl, halo, cyano, oxo, —$OR^A$, —$NR^BR^C$, —$NR^BC(O)R^D$, —$NO_2$, —$C(O)NR^BR^C$, —$C(O)R^D$, —$C(O)OR^D$, —$SR^E$, or —$S(O)_x$ $R^D$, wherein each alkyl, alkylene, alkenyl, alkynyl, heteroalkyl, haloalkyl, cycloalkyl, heterocyclyl, aryl, and heteroaryl is optionally substituted with one or more $R^6$; or two $R^1$ groups, together with the atoms to which they are attached, form a 3-7-membered cycloalkyl, heterocyclyl, aryl, or heteroaryl, wherein each cycloalkyl, heterocyclyl, aryl, and heteroaryl is optionally substituted with one or more $R^6$;

each $R^2$ is independently hydrogen, $C_1$-$C_6$-alkyl, $C_2$-$C_6$-alkenyl, $C_2$-$C_6$-alkynyl, $C_1$-$C_6$-heteroalkyl, $C_1$-$C_6$-haloalkyl, halo, cyano, or —$OR^A$;

$R^{3a}$ and $R^{3b}$ are each independently hydrogen, $C_1$-$C_6$-alkyl, $C_1$-$C_6$-heteroalkyl, $C_1$-$C_6$-haloalkyl, halo, cyano, —$OR^A$, —$NR^BR^C$, —$C(O)R^D$, or —$C(O)OR^D$; or each of $R^{3a}$ and $R^{3b}$, together with the carbon atom to which they are attached, form an oxo group;

$R^{3c}$ is hydrogen or $C_1$-$C_6$-alkyl;

each $R^4$ is independently hydrogen, $C_1$-$C_6$-alkyl, or $C_1$-$C_6$-haloalkyl;

each $R^5$ is independently hydrogen, $C_1$-$C_6$-alkyl, $C_1$-$C_6$-heteroalkyl, $C_1$-$C_6$-haloalkyl, cycloalkyl, halo, cyano, oxo, —$OR^A$, —$NR^BR^C$, —$C(O)R^D$, or —$C(O)OR^D$;

each $R^6$ is independently $C_1$-$C_6$-alkyl, $C_2$-$C_6$-alkenyl, $C_2$-$C_6$-alkynyl, $C_1$-$C_6$-heteroalkyl, $C_1$-$C_6$-haloalkyl, cycloalkyl, heterocyclyl, aryl, heteroaryl, halo, cyano, oxo, —$OR^A$, —$NR^BR^C$, —$NR^BC(O)R^D$, —$NO_2$, —$C(O)NR^BR^C$, —$C(O)R^D$, —$C(O)OR^D$, —$SR^E$, or —$S(O)_xR^D$, wherein each alkyl, alkenyl, alkynyl, heteroalkyl, haloalkyl, cycloalkyl, heterocyclyl, aryl, and heteroaryl is optionally substituted with one or more $R^{11}$;

each $R^7$ is $C_1$-$C_6$-alkyl, halo, cyano, oxo, or —$OR^{A1}$;

each $R^{11}$ is independently $C_1$-$C_6$-alkyl, $C_1$-$C_6$-heteroalkyl, $C_1$-$C_6$-haloalkyl, cycloalkyl, heterocyclyl, aryl, heteroaryl, halo, cyano, oxo, or —$OR^A$;

each $R^A$ is independently hydrogen, $C_1$-$C_6$ alkyl, $C_1$-$C_6$ haloalkyl, aryl, heteroaryl, $C_1$-$C_6$ alkylene-aryl, $C_1$-$C_6$ alkylene-heteroaryl, —$C(O)R^D$, or —$S(O)_x$ $R^D$;

each of $R^B$ and $R^C$ is independently hydrogen, $C_1$-$C_6$ alkyl, $C_1$-$C_6$ heteroalkyl, cycloalkyl, heterocyclyl, or —$OR^A$; or $R^B$ and $R^C$ together with the atom to which they are attached form a 3-7-membered heterocyclyl ring optionally substituted with one or more $R^7$;

each $R^D$ and $R^E$ is independently hydrogen, $C_1$-$C_6$ alkyl, $C_2$-$C_6$ alkenyl, $C_2$-$C_6$ alkynyl, $C_1$-$C_6$ heteroalkyl, $C_1$-$C_6$ haloalkyl, cycloalkyl, heterocyclyl, aryl, heteroaryl, $C_1$-$C_6$ alkylene-aryl, or $C_1$-$C_6$ alkylene-heteroaryl;

each $R^{A1}$ is hydrogen or $C_1$-$C_6$-alkyl;

m is 0, 1, or 2; and x is 0, 1, or 2.

12. The compound of claim 1, wherein the compound of Formula (I) is a compound of Formula (I-c):

(I-c)

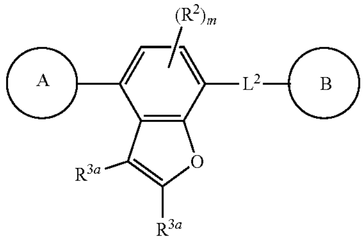

or a pharmaceutically acceptable salt, solvate, hydrate, tautomer, or stereoisomer thereof, wherein each of A, B, $L^2$, $R^2$, $R^{3a}$, m, and subvariables thereof are defined as in claim 1.

13. The compound of claim 1, wherein the compound of Formula (I-a) is a compound of Formula (I-d):

(I-d)

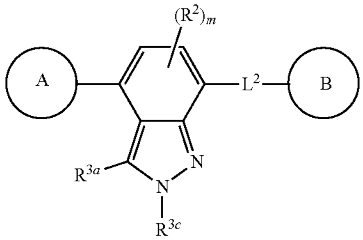

or a pharmaceutically acceptable salt, solvate, hydrate, tautomer, or stereoisomer thereof, wherein each of A, B, $L^2$, $R^2$, $R^{3a}$, $R^{3c}$, m, and subvariables thereof are defined as in claim 1.

14. The compound of claim 1, wherein the compound of Formula (I-a) is a compound of Formula (I-e):

(I-e)

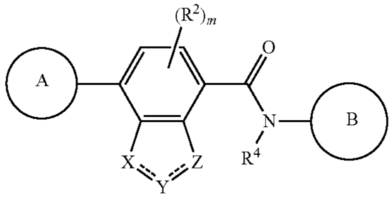

or a pharmaceutically acceptable salt, solvate, hydrate, tautomer, or stereoisomer thereof, wherein each of A, B, X, Y, Z, $L^2$, $R^2$, $R^4$, m, and subvariables thereof are defined as in claim 1.

15. The compound of claim 1, wherein the compound of Formula (I) is a compound of Formula (I-h):

(I-h)

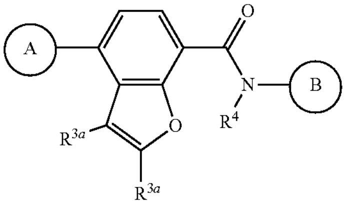

or a pharmaceutically acceptable salt, solvate, hydrate, tautomer, or stereoisomer thereof, wherein each of A, B, $L^2$, $R^{3a}$, $R^4$, m, and subvariables thereof are defined as in claim 1.

16. The compound of claim 1, wherein the compound is selected from:

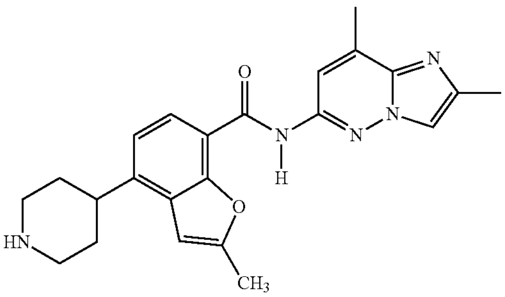

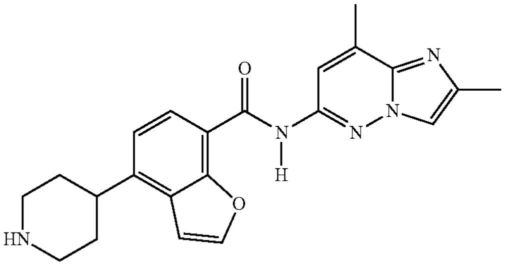

-continued
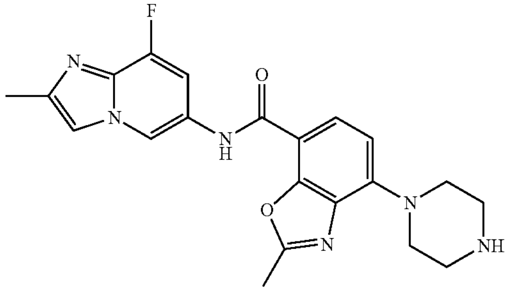
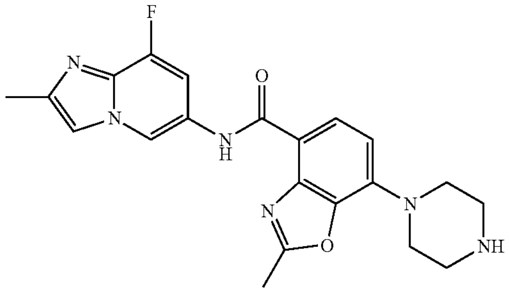
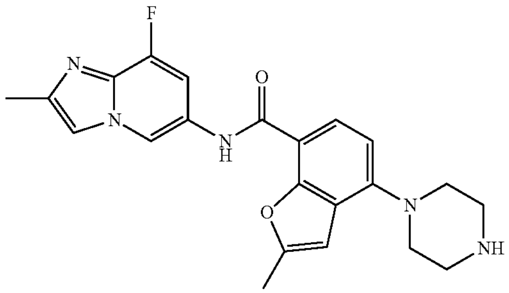
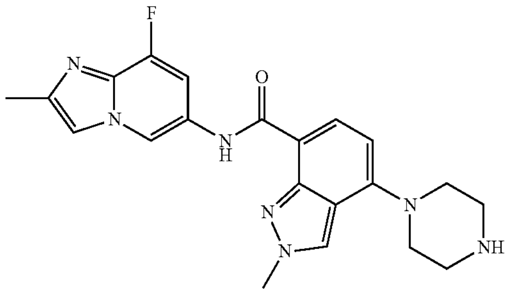
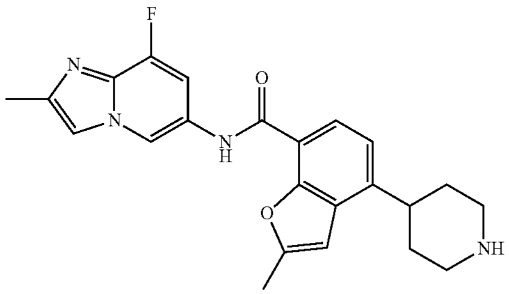
-continued
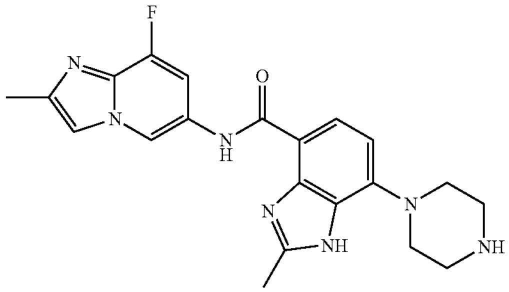
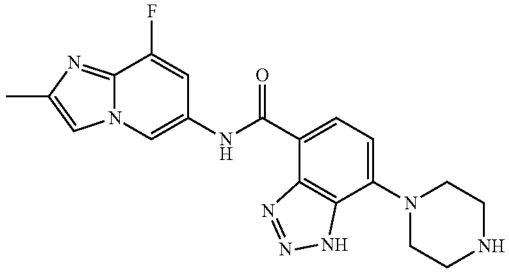
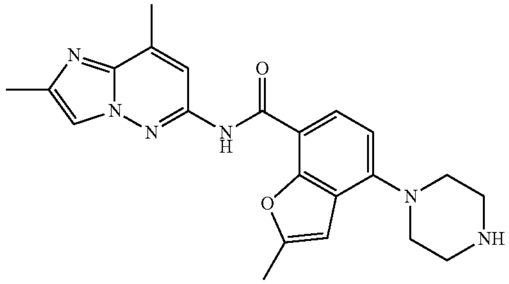
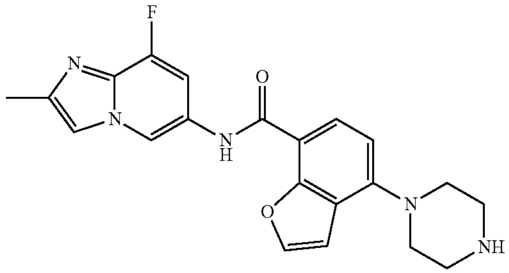
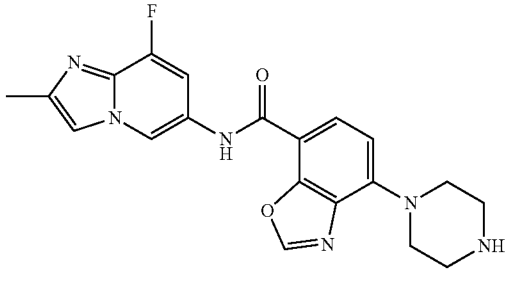
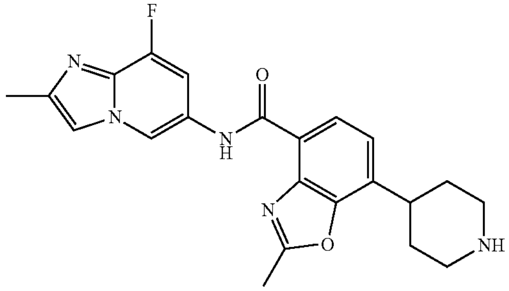

-continued
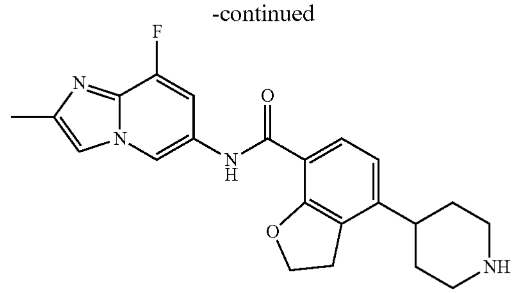
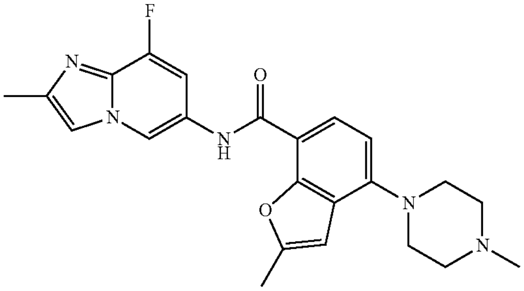
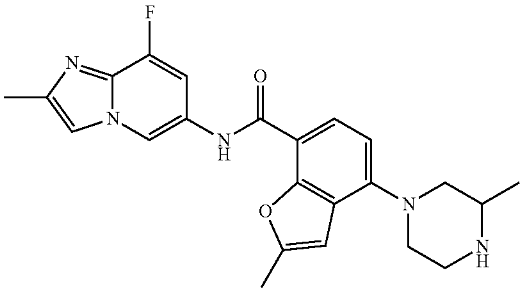
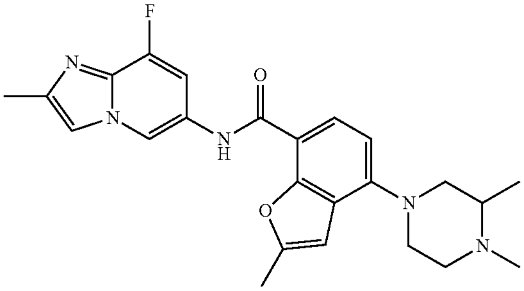
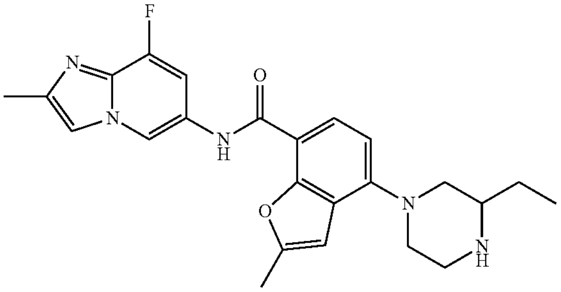
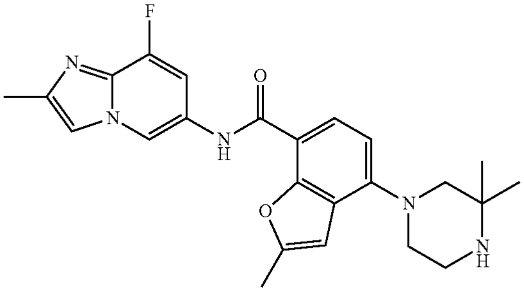
-continued
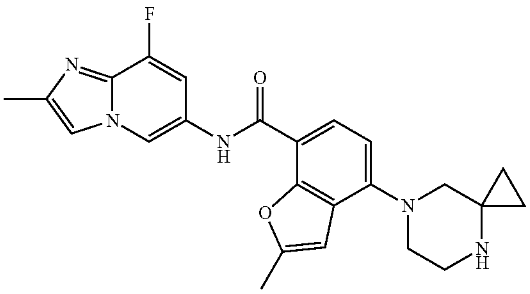
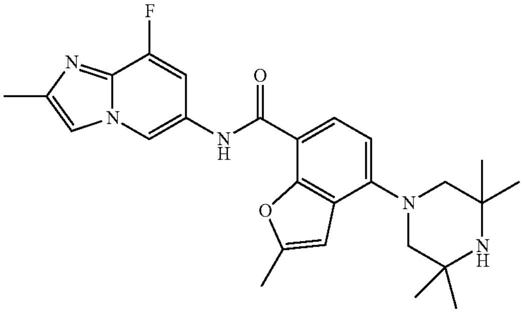
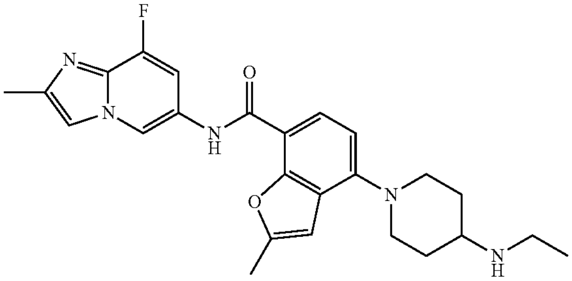
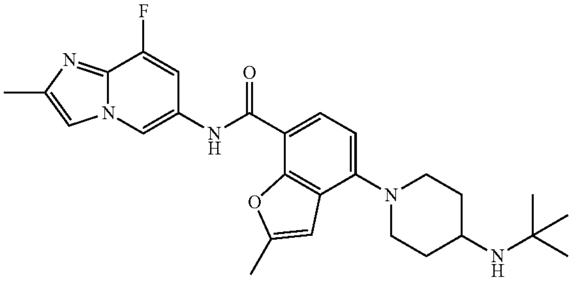
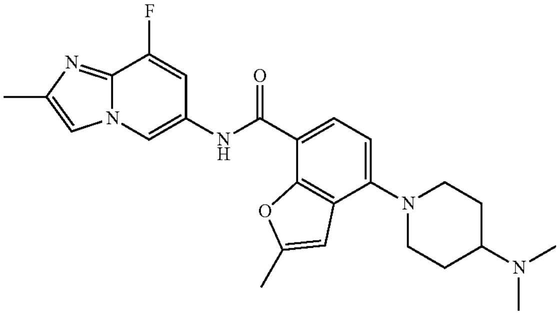

-continued
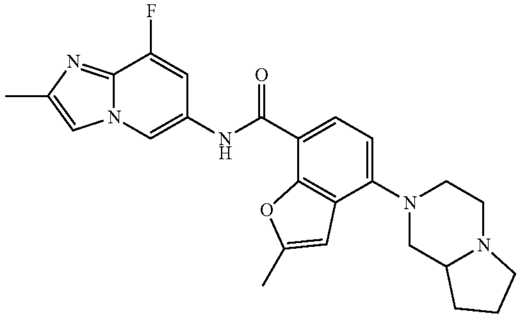
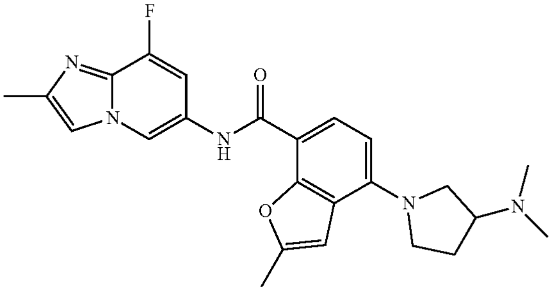
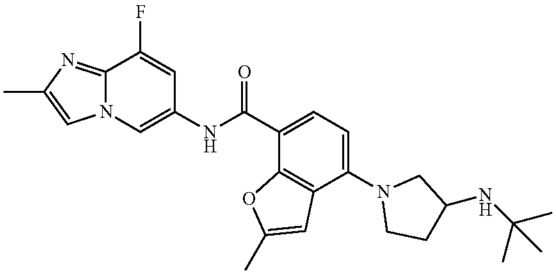
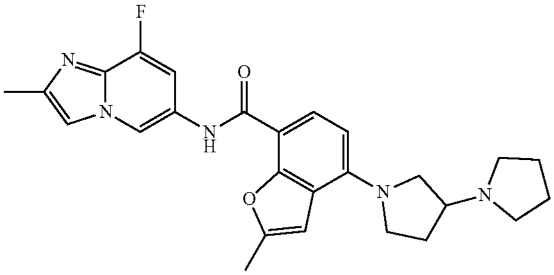
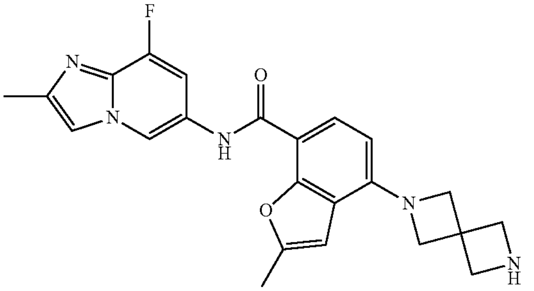
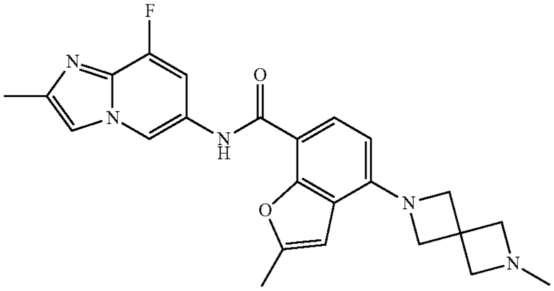
-continued
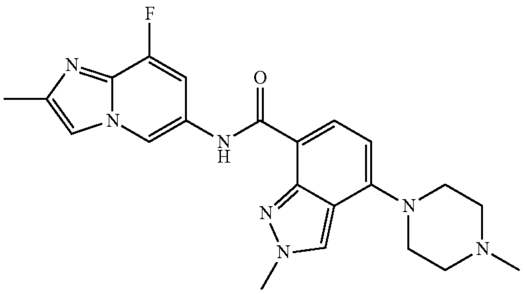
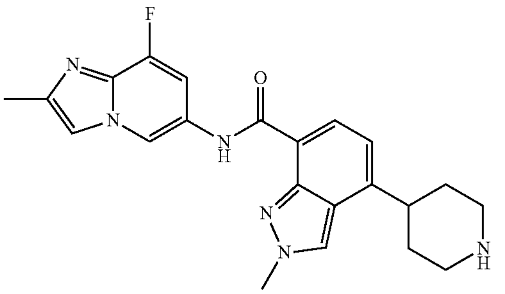
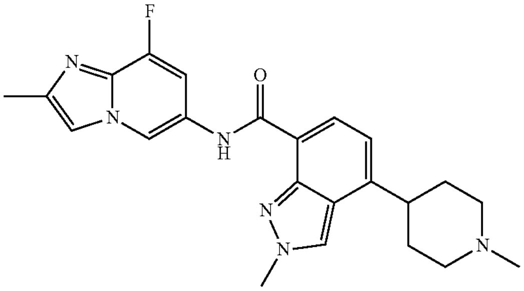
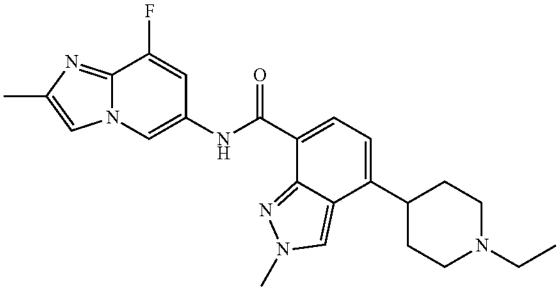
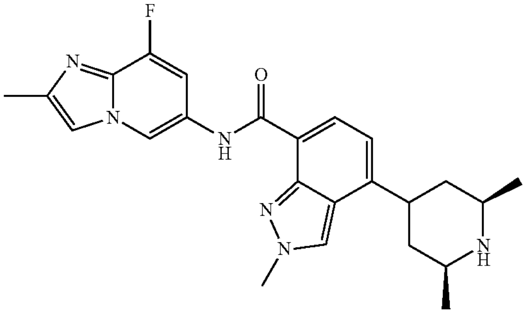

-continued
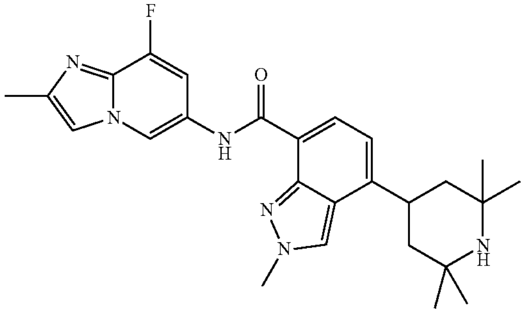
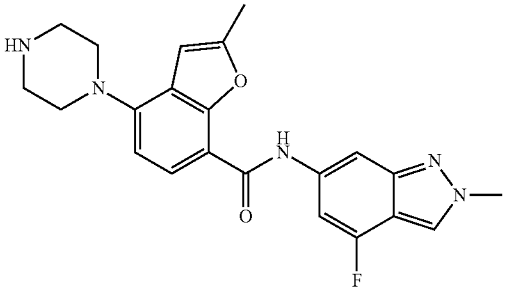
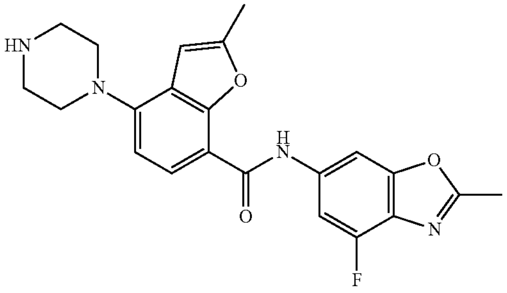
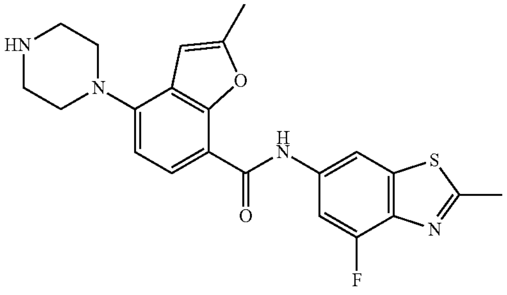
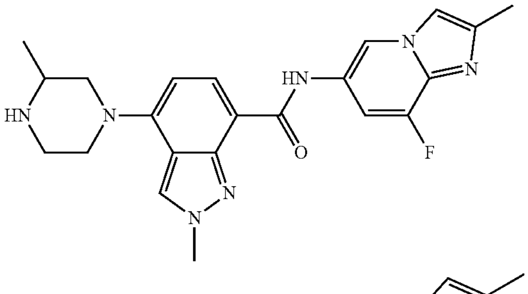
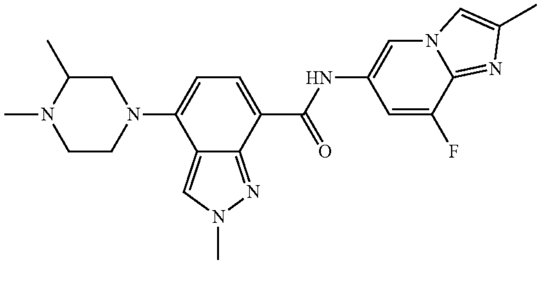
-continued
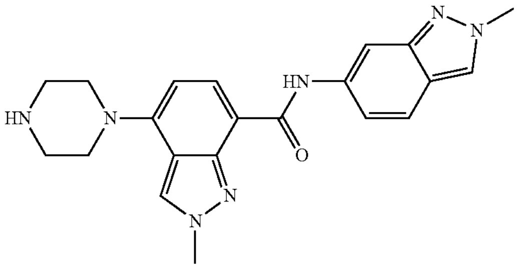
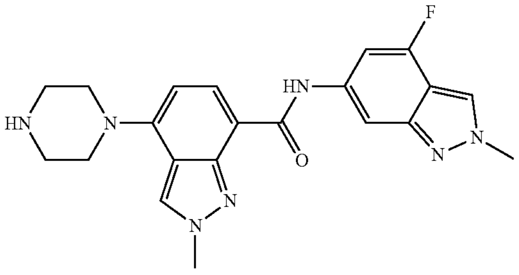
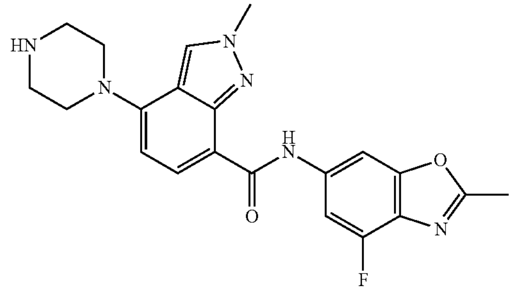
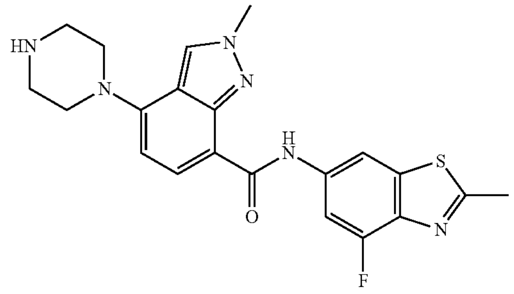
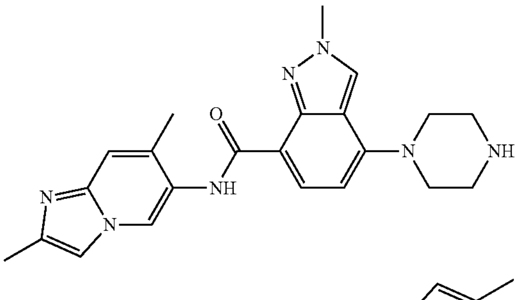
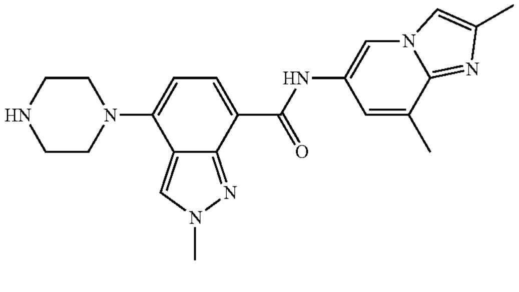

-continued
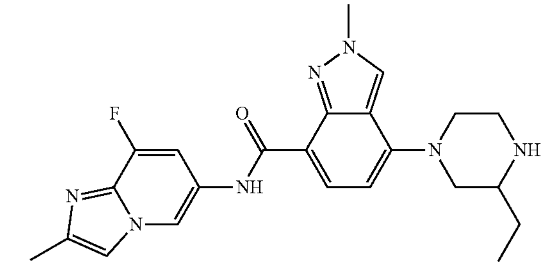
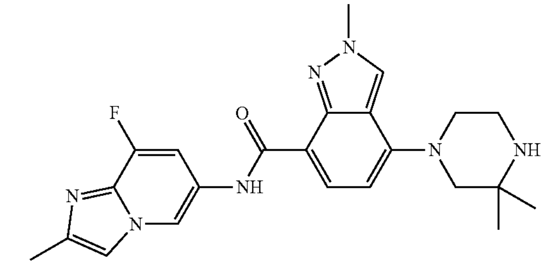
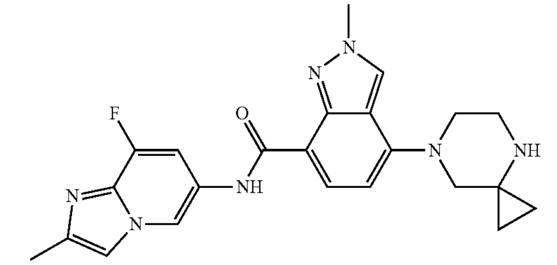
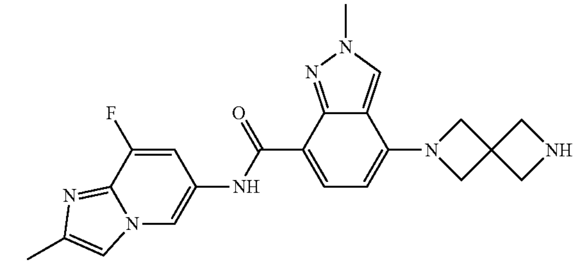
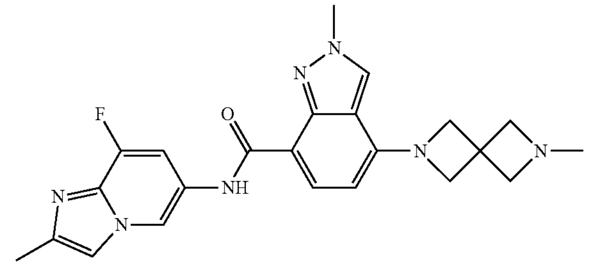
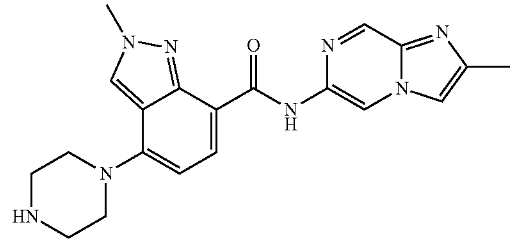
-continued
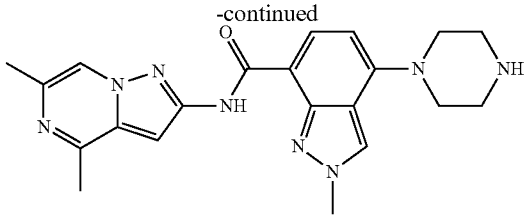
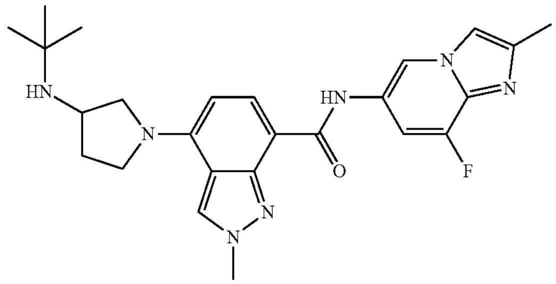
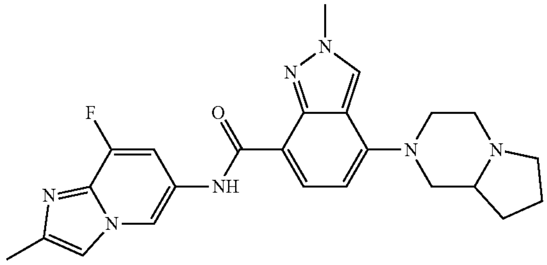
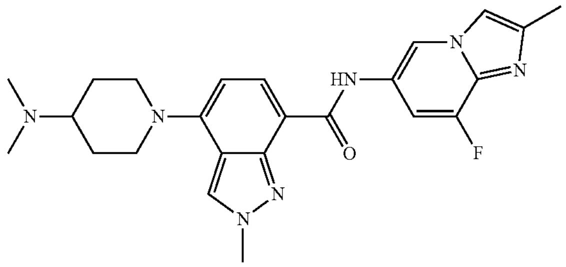
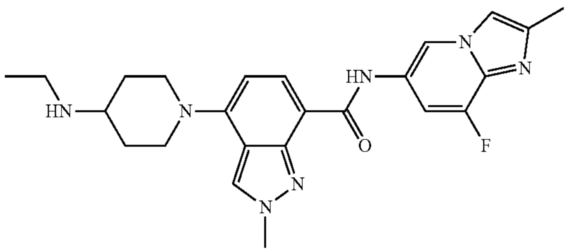
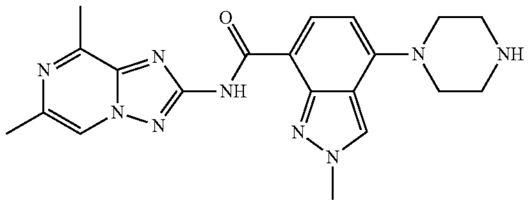

-continued
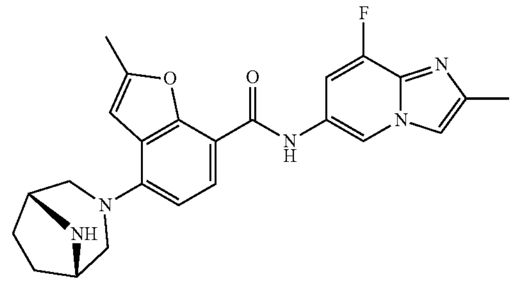
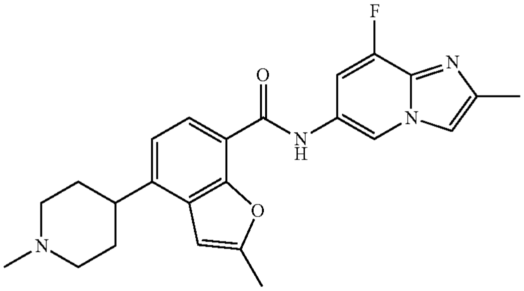
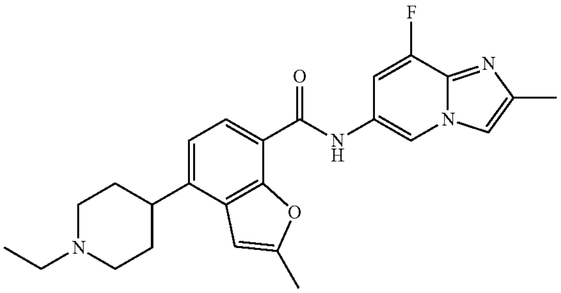
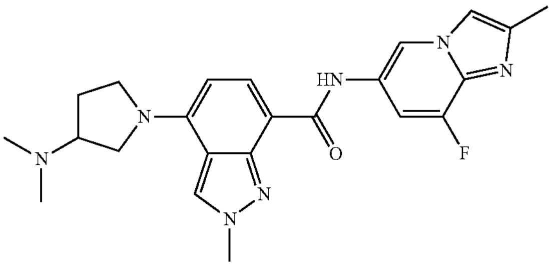
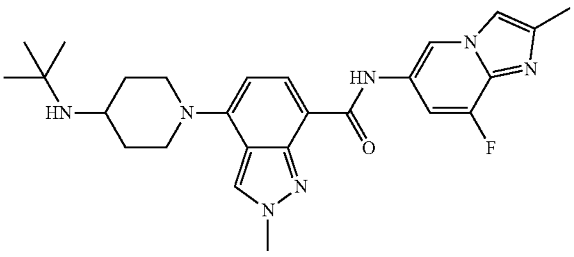
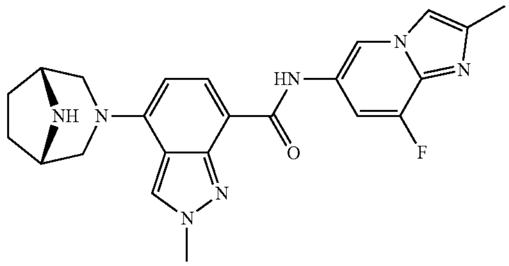
-continued
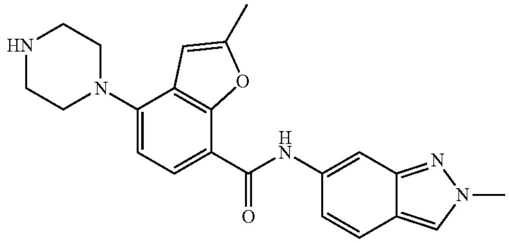
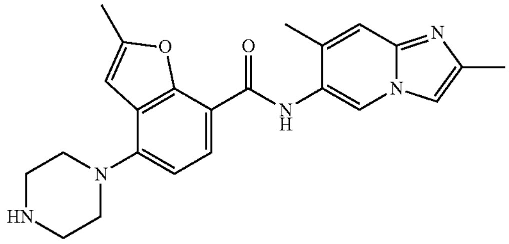
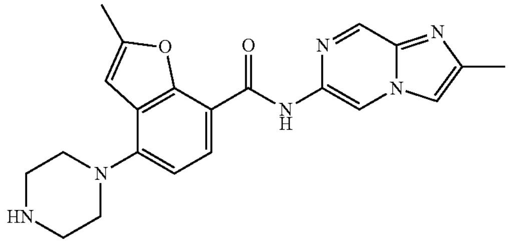
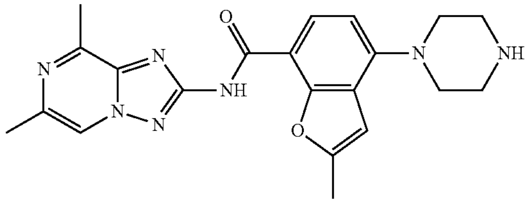
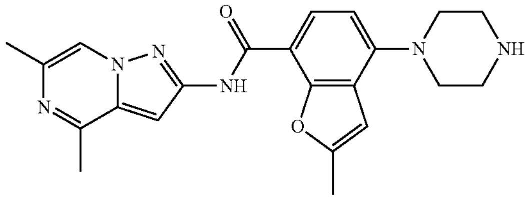
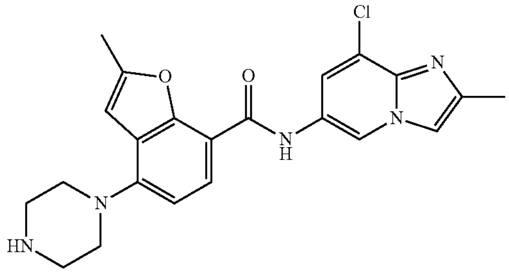
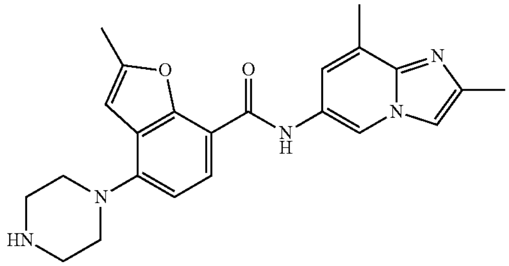

-continued
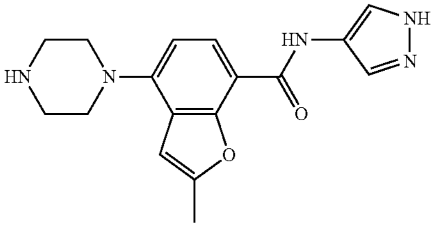
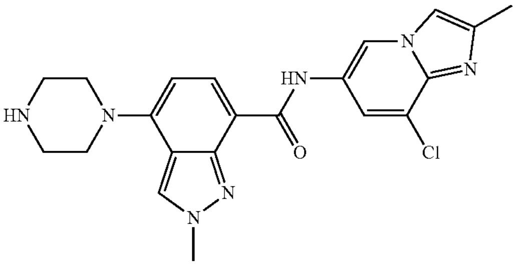
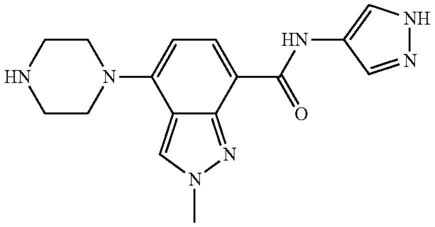
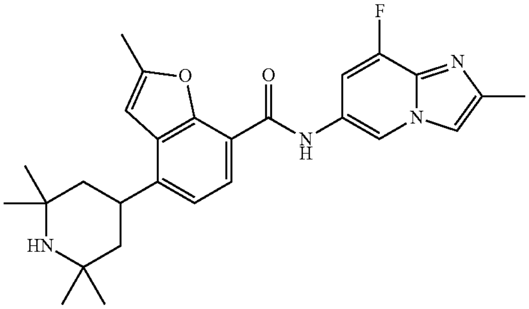
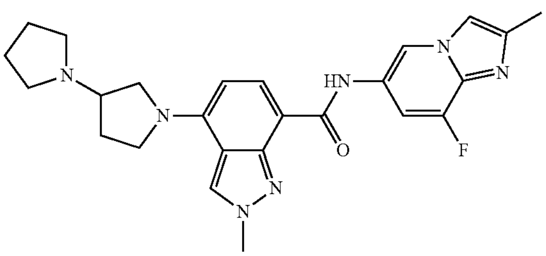
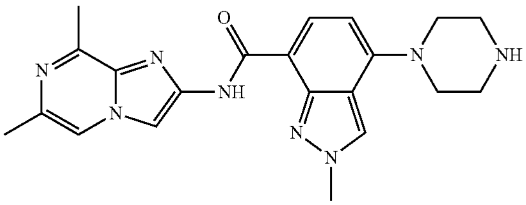
-continued
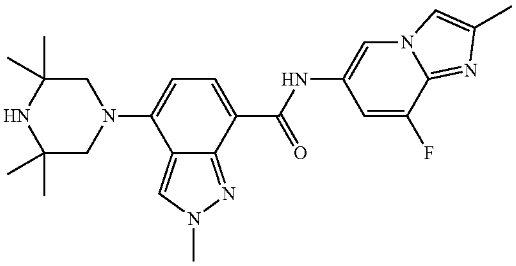
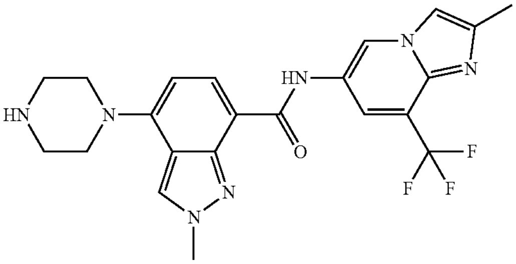
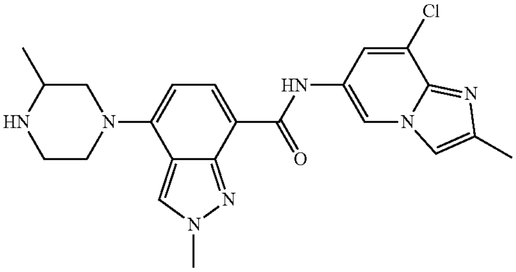
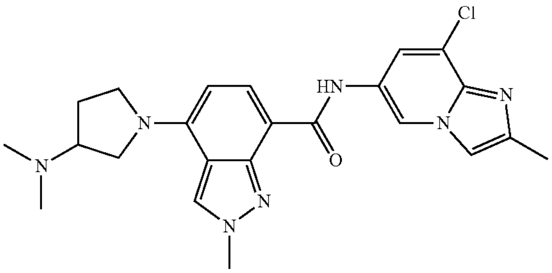
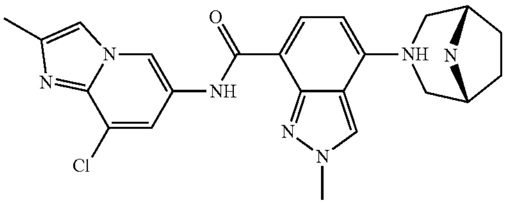
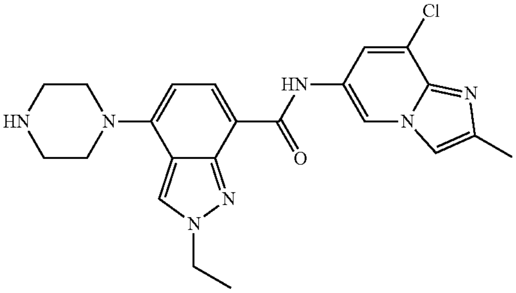

-continued

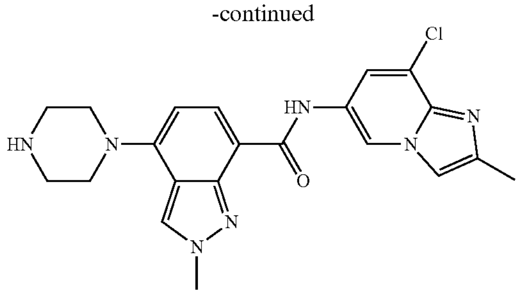

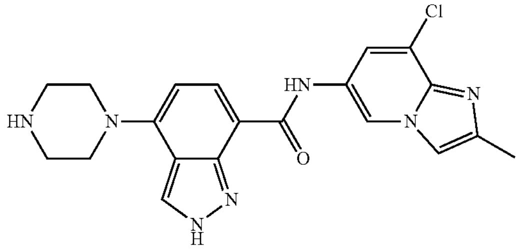

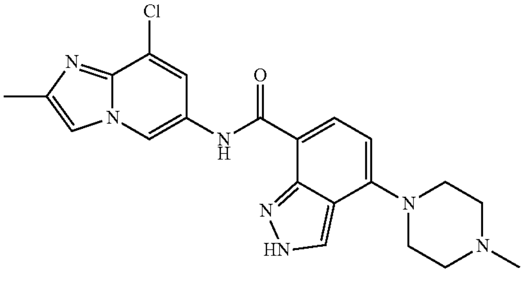

or a pharmaceutically acceptable salt, solvate, hydrate, tautomer, or stereoisomer thereof.

17. The compound of claim 1, wherein:

(a) the compound alters a target nucleic acid;

(b) the compound binds to a target nucleic acid; or (c) the compound stabilizes a target nucleic acid.

18. The compound of claim 1, wherein:

(a) the compound increases splicing at splice site on a target nucleic acid, by 0.5%, 1%, 2%, 3%, 4%, 5%, 6%, 7%, 8%, 9%, 10%, 15%, 20%, 25%, 30%, 35%, 40%, 45%, 50%, 55%, 60%, 65%, 70%, 75%, 80%, 85%, 90%, 95%, or more, as determined by qPCR; or (b) the compound decreases splicing at splice site on a target nucleic acid, by 0.5%, 1%, 2%, 3%, 4%, 5%, 6%, 7%, 8%, 9%, 10%, 15%, 20%, 25%, 30%, 35%, 40%, 45%, 50%, 55%, 60%, 65%, 70%, 75%, 80%, 85%, 90%, 95%, or more, as determined by qPCR.

19. A pharmaceutical composition comprising a compound of claim 1 and a pharmaceutically acceptable excipient.

20. A composition for use in treating a disease or disorder in a subject comprising administering to the subject a compound of Formula (I-a) according to claim 1.

21. The composition for use of claim 20, wherein the disease or disorder comprises a proliferative disease.

22. The composition for use of claim 20, wherein the disease or disorder comprises a neurological disease or disorder, autoimmune disease or disorder, immunodeficiency disease or disorder, lysosomal storage disease or disorder, cardiovascular disease or disorder, metabolic disease or disorder, respiratory disease or disorder, renal disease or disorder, or infectious disease.

* * * * *